United States Patent
Nielsen et al.

(10) Patent No.: US 9,238,080 B2
(45) Date of Patent: *Jan. 19, 2016

(54) BI-SPECIFIC FUSION PROTEINS

(75) Inventors: Ulrik Nielsen, Quincy, MA (US);
Thomas Wickham, Groton, MA (US);
Birgit Schoeberl, Cambridge, MA (US);
Brian Harms, Roslindale, MA (US);
Bryan Linggi, Richland, WA (US);
Matthew Onsum, Jamaica Plain, MA (US); Byron DeLaBarre, Cambridge, MA (US); Shaun M. Lippow, San Francisco, CA (US)

(73) Assignee: Merrimack Pharmaceuticals, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/068,808

(22) Filed: May 20, 2011

(65) Prior Publication Data
US 2011/0293579 A1 Dec. 1, 2011

Related U.S. Application Data

(60) Provisional application No. 61/347,040, filed on May 21, 2010.

(51) Int. Cl.
| | |
|---|---|
| *C07K 14/475* | (2006.01) |
| *C12N 15/62* | (2006.01) |
| *A61K 47/48* | (2006.01) |
| *B82Y 5/00* | (2011.01) |
| *A61K 45/06* | (2006.01) |
| *C07K 16/46* | (2006.01) |
| *A61K 38/00* | (2006.01) |

(52) U.S. Cl.
CPC .......... *A61K 47/48538* (2013.01); *A61K 45/06* (2013.01); *A61K 47/48346* (2013.01); *A61K 47/48415* (2013.01); *A61K 47/48723* (2013.01); *B82Y 5/00* (2013.01); *C07K 14/475* (2013.01); *C07K 16/46* (2013.01); *C12N 15/62* (2013.01); *A61K 38/00* (2013.01); *C07K 2319/00* (2013.01)

(58) Field of Classification Search
CPC ... C07K 14/475; C07K 2319/00; C12N 15/62
See application file for complete search history.

(56) References Cited

U.S. PATENT DOCUMENTS

| | | | |
|---|---|---|---|
| 5,632,986 | A | 5/1997 | Tait et al. |
| 6,566,098 | B1 | 5/2003 | Chan et al. |
| 7,226,907 | B1 | 6/2007 | Zhou |
| 7,459,541 | B2 | 12/2008 | Hall et al. |
| 7,531,318 | B2 | 5/2009 | Srivastava et al. |
| 7,576,186 | B2 | 8/2009 | Lum et al. |
| 7,612,164 | B2 | 11/2009 | Zhou |
| 8,067,357 | B2 | 11/2011 | Reutelingsperger et al. |
| 8,158,581 | B2 | 4/2012 | Glass et al. |
| 8,748,380 | B2 | 6/2014 | Plumridge et al. |
| 2005/0043236 | A1* | 2/2005 | Daly et al. ............. 514/12 |
| 2006/0018897 | A1 | 1/2006 | Lee et al. |
| 2006/0275254 | A1* | 12/2006 | Kim et al. .............. 424/85.1 |
| 2007/0110733 | A1 | 5/2007 | Lum |
| 2007/0172811 | A1 | 7/2007 | Srivastava et al. |
| 2008/0050370 | A1* | 2/2008 | Glaser et al. ........... 424/133.1 |
| 2009/0068181 | A1 | 3/2009 | Lee et al. |
| 2009/0093407 | A1 | 4/2009 | Hall et al. |
| 2009/0214507 | A1 | 8/2009 | Srivastava et al. |
| 2010/0055115 | A1 | 3/2010 | Lum et al. |
| 2010/0291080 | A1 | 11/2010 | Lee et al. |
| 2011/0045007 | A1 | 2/2011 | Schuurman et al. |
| 2011/0059076 | A1 | 3/2011 | McDonagh et al. |
| 2012/0244163 | A1 | 9/2012 | Schoeberl et al. |
| 2014/0315817 | A1 | 10/2014 | Schmidt et al. |

FOREIGN PATENT DOCUMENTS

| | | |
|---|---|---|
| EP | 2 275 446 | 1/2011 |
| WO | 9208495 A1 | 5/1992 |
| WO | 9633698 A1 | 10/1996 |
| WO | WO 00/02587 | 1/2000 |
| WO | WO 2005/117973 | 12/2005 |
| WO | WO 2006/003488 * | 1/2006 |
| WO | WO 2006/004910 | 1/2006 |
| WO | WO 2006/128125 * | 5/2006 |
| WO | 2006076525 A2 | 7/2006 |
| WO | WO 2006/079120 | 7/2006 |
| WO | WO 2006/091209 | 8/2006 |
| WO | 2007021494 A2 | 2/2007 |
| WO | WO 2007/044887 | 4/2007 |
| WO | 2008063424 A2 | 5/2008 |

(Continued)

OTHER PUBLICATIONS

Bujak, 2007, Cardiovascular Research, vol. 74, issue 2, pp. 184-195.*
Henson, 2006, Cellular signaling, vol. 18, pp. 2089-2097.*
Adderson, E., et al., "Molecular analysis of polyreactive monoclonal antibodies from rheumatic carditis: human anti-N-acetylglucosamine/anti-myosin antibody V region genes," J Immunol., 161(4):2020-2031, (Aug. 15, 1998).
Andrades, et al., "Engineering, expression, and renaturation of a collagen-targeted human bFGF fusion protein," Growth Factors, 18:261-275, (Aug. 1999).

(Continued)

*Primary Examiner* — Prema Mertz
(74) *Attorney, Agent, or Firm* — Greenberg Traurig, LLP; Natalie Salem

(57) ABSTRACT

Bi-specific fusion proteins with therapeutic uses are provided, as well as pharmaceutical compositions comprising such fusion proteins, and methods for using such fusion proteins to repair or regenerate damaged or diseased tissue. The bi-specific fusion proteins generally comprise: (a) a targeting polypeptide domain that binds to a target molecule; and (b) an activator domain that detectably modulates tissue regeneration.

21 Claims, 37 Drawing Sheets

(33 of 37 Drawing Sheet(s) Filed in Color)

(56) References Cited

FOREIGN PATENT DOCUMENTS

| WO | 2008089567 A1 | 7/2008 |
|---|---|---|
| WO | WO 2008/091209 | 8/2008 |
| WO | WO 2008/096158 | 8/2008 |
| WO | WO 2008/151005 | 12/2008 |
| WO | WO 2008/155134 | 12/2008 |
| WO | WO 2009/126920 | 10/2009 |
| WO | WO 2010/059315 | 5/2010 |

OTHER PUBLICATIONS

Askari, et al., "Effect of stromal-cell-derived factor 1 on stem-cell homing and tissue regeneration in ischaemic cardiomyopathy," Mechanisms of Disease, 362: 697-703, (Aug. 30, 2003).
Bai et al., "Tracking long-term survival of intramyocardially delivered human adipose tissue-derived stem cells using bioluminescence imaging," Molecular Imaging and Biology, 13 pages (2010).
Barbas, S., et al., "Human autoantibody recognition of DNA," Proc Natl Acad Sci U S A, 92(7):2529-2533, (Mar. 28, 1995).
Bauwens, C., et al., "Geometric control of cardiomyogenic induction in human pluripotent stem cells", Tissue Eng., Part A, (Apr. 25, 2011).
Bersell, et al., "Neuregulin1/ErbB4 signaling induces cardiomyocyte proliferation and repair of heart injury," Cell, 138:257-270, (Jul. 24, 2009).
Black, S., "In vivo models of myocardial ischemia and reperfusion injury: application to drug discovery and evaluation," J. Pharmacol. Toxicol. Methods 43(2):153-167, (Mar.-Apr. 2000).
Bock-Marquette, et al., "Thymosin B4 activates integrin-linked kinase and promotes cardiac cell migration, survival and cardiac repair," Nature, 432:466-472, (Nov. 25, 2004).
Buerke, et al., "Cardioprotective effect of insulin-like growth factor I in myocardial ischemia followed by reperfusion," Proc. Natl. Acad. Sci. USA, 92: 8031-8035, (Aug. 1995).
Burchfield, et al., "Interleukin-10 from transplanted bone marrow mononuclear cells contributes to cardiac protection after myocardial infarction," Circulation Research, 15 pages, (Mar. 23, 2011).
Burchfield, et al., "Role of paracrine factors in stem and progenitor cell mediated cardiac repair and tissue fibrosis," Fibrogenesis and Tissue Repair, 1(4):1-11, (2008).
Burchfield, et al., "The cytoprotective effects of tumor necrosis factor are conveyed through tumor necrosis factor receptor-associated factor 2 in the heart," Circulation Heart Failure, 16 pages, (Jan. 2010).
Chen, et al . "Effects of receptor binding on plasma half-life of bifunctional transferrin fusion proteins,"Molecular Pharmaceutics 8: 457-65 (2011).
Chen, et al., "Localization of monoclonal antibody TNT-1 in experimental kidney infarction of the mouse," FASEB J., 4(12):3033-3039, (Sep. 1, 1990).
Chimenti, et al., "Myocardial infarction: animal models," Methods. Mol. Med., 98:217-226, (2004).
Christman, et al., "Enhanced neovasculature formation in ischemic myocardium following delivery of pleiotrophin plasmid in a biopolymer,"Biomaterials, 26:1139-1144 (2005).
Davis, "Local myocardial insulin-like growth factor 1 (IGF-1) delivery with biotinylated peptide nanofibers improves cell therapy for myocardial infarction," Proc. Natl. Acad. Sci USA, 103(21):8155-8160, (May 23, 2006).
Davletov, A. & Sudhof, T., "A single C2 domain from synaptotagmin I is sufficient for high affinity Ca2+/phospholipid binding," J. Biol. Chem., 268(35):26386-2690, (Dec. 15, 1993).
Dorn II, M.D., "Periostin and myocardial repair, regeneration, and recovery," The New England Journal of Medicine, 357(15):1552-1554, (Oct. 11, 2007).
Dumont, et al., "Cardiomyocyte Death Induced by Myocardial Ischemia and Reperfusion: Measurement With Recombinant Human Annexin-V in a Mouse Model ," Circulation 102(13):1564-1568, (Sep. 26, 2000).
Engel, et al., "FGF1/p38 MAP kinase inhibitor therapy induces cardiomyocyte mitosis, reduces scarring, and rescues function after myocardial infarction," PNAS, 103(42):15546-15551, (Oct. 17, 2006).

George, et al., "Typhostin AG-556 reduces myocardial infarct size and improves cardiac performance in the rat," Experimental and Molecular Pathology, 74:314-318 (2003).
Gnecchi, et al., "Evidence supporting paracrine hypothesis for Akt-modified mesenchymal stem cell-mediated cardiac protection and functional improvement," The FASEB Journal, 20:661-669, (Apr. 2006).
Gnecchi, et al., "Paracrine mechanisms in adult stem cell signaling and therapy," Adult Stem Cells and Paracrine Effects, 1204-1219, (Nov. 2008).
Greenberg, et al., "Chapter 7. Mouse models of ischemic angiogenesis and ischemia-reperfusion injury," Methods Enzymol., 444:159-174, (2008).
Gripenberg, et al., "A Solid Phase Enzyme-linked Immunosorbent Assay (ELISA) for the Demonstration of Antibodies against Denatured, Single-stranded DNA in Patient Sera," Scand. J. Immunol , 7(2):151-157, (Feb. 1978).
Han, et al., "Refolding of a recombinant collagen-targeted TGF-B2 fusion protein expressed in *Escherichia coli*," Protein Expression and Purification, 11:169-178 (1997).
Hashino, K., et al., "A 31-kDa Recombinant Fibronectin Cell-Binding Domain Fragment: Its Binding to Receptor, Cell Adhesive Activity, and Fusion Proteins," J. Biochem., 119(4):604-609, (Apr. 4, 1996).
Hausenloy et al., "Cardioprotective growth factors," Cardiovascular Research, 83: 179-194, (2009).
Hefta, et al., "Measuring Affinity Using Biosensors", in "Antibody engineering: A Practical Approach", pp. 99-116, Oxford University Press, 1996, Edited by McCafferty et al., (Hames B.D.eds).
Hinkel et al., "Thymosin B4 is an essential paracrine factor of embryonic endothelial progenitor cell-mediated cardioprotection," Circulation, 2232-2240 (Apr. 29, 2008).
Hoberg, E., et al., "Monoclonal antibodies specific for human cardiac myosin: selection, characterization and experimental myocardial infarct imaging," Eur Heart J., 9(3):328-236, (Mar. 1988).
Hofstra, et al., "Visualisation of cell death in vivo in patients with acute myocardial infarction," The Lancet, 356(9225):209-212, (2000).
Hsieh et al., "Local controlled intramyocardial delivery of plateet-derived growth factor improves postinfarction ventricular function without pulmonary toxicity," Circulation, 637-644, (Aug. 15, 2006).
Hu et al., Stromal cell-derived factor-1a confers protection against myocardial ischemia/reperfusion injury, Molecular Cardiology, 654-663, (Aug. 7, 2007).
Ieda, et al., "Cardiac fibroblasts regulate myocardial proliferation through B1 integrin signaling," Developmental Cell, 16: 233-244 (Feb. 17, 2009).
Igarashi, K., et al., "Specific binding of a synthetic peptide derived from an antibody complementarity determining region to phosphatidylserine," J Biochem.,117(2):452-457, (Feb. 1995).
Ishikawa, et al., "Production of biologically active epidermal growth factor fusion protein with high collagen affinity," J. Biochem., 129(4): 627-633 (2001).
Jeon, et al., "Long-term and zero-order release of basic fibroblast growth factor from heparin-conjugated poly(L-lactide-co-glycolide) nanospheres and fibrin gel," Biomaterials, 27:1598-1607 (2006).
Kanashiro-Takeuchi, et al., "Cardioprotective effects of growth hormone-releasing hormone agonist after myocardial infarction," PNAS, 107(6):2604-2609, (Feb. 9, 2010).
Kardami, et al., "Fibroblast growth factor-2 and cardioprotection," Heart Fail Rev., 12:267-277 (2007).
Kawase Y. et al. "Construction and characterization of a fusion protein with epidermal growth factor and the cell-binding domain of fibronectin" FEBS letters, 298(2-3),: 126-128, 1992.
Kenis, H., et al., "Annexin A5 uptake in ischemic myocardium: demonstration of reversible phosphatidylserine externalization and feasibility of radionuclide imaging," J Nucl Med., 51(2):259-67, (Feb. 2010).
Kenis, H., et al., "Cell surface-expressed phosphatidylserine and annexin A5 open a novel portal of cell entry," J Biol Chem., 279(50):52623-52629, Epub Sep. 20, 2004, (Dec. 10, 2004).

(56) References Cited

OTHER PUBLICATIONS

Khaw, B., et al., "Monoclonal antibody to cardiac myosin: imaging of experimental myocardial infarction," Hybridoma, 3(1):11-23, (1984).

Klopsch, et al., "Intracardiac injection of erythropoietin induces stem cell recruitment and improves cardiac functions in a rat myocardial infarction model," J. Cell. Mol. Med. 13(4): 664-679, (2009).

Ko, Y., et al., "Gene delivery into ischemic myocardium by double-targeted lipoplexes with anti-myosin antibody and TAT peptide," Gene Ther., 16(1):52-9. Epub Aug. 14, 2008, (Jan. 2009).

Kobayashi, et al., "Effect of atrial natriuretic peptide on ischemia-reperfusion injury in a porcine total hepatic vascular exclusion model," World J. Gastroenterol., 13(25):3487-3492, (Jul. 7, 2007).

Kuhn, et al., "Periostin induces proliferation of differentiated cardiomyocytes and promotes cardiac repair," Nature Medicine, 13(8):962-969, (Aug. 2007).

Kuramochi, "Cardiac Endothelial Cells Regulate Reactive Oxygen Species-induced Cardiomyocyte Apoptosis through Neuregulin-1_/erbB4 Signaling*," J. Biol. Chem., 279(49): 51141-51147, (2004).

Laroche-Traineau, J., et al., "A human monoclonal antibody obtained from EBV-transformed B cells with specificity for myosin," Br J Haematol., 91(4):951-962, (Dec. 1995).

Laroche-Traineau, J., et al., "Analysis of the V genes coding for a monospecific human antibody to myosin and functional expression of single chain Fv fragments," FEBS Lett., 460(1):86-92, (Oct. 22, 1999).

Laroche-Traineau, J., et al., "Three-step purification of bacterially expressed human single-chain Fv antibodies for clinical applications," J Chromatogr B Biomed Sci Appl., 737(1-2):107-117, (Jan. 14, 2000).

Liang, W., et al., "ATP-containing immunoliposomes specific for cardiac myosin," Curr Drug Deliv., 1(1):1-7, (Jan. 2004).

Liu, et al., "Neuregulin-1/erbB-activation improves cardiac function and survival in models of ischemic, dilated, and viral cardiomyopathy," Journal of the American College of Cardiology, 48(7):1438-1447, (Oct. 3, 2006).

Lorts, et al., "Genetic manipulation of periostin expression in the heart does not affect myocyte content, cell cycle activity, or cardiac repair," UltraRapid Communication, e1-e7, (Jan. 2, 2009).

Marshall, K.W. & Marks, J.D. "Engineering and characterization of a novel fusion protein incorporating B7.2 and an anti-ErbB-2 single-chain antibody fragment for the activation of Jurkat T cells," Journal of Immunotherapy. Hagerstown, Md. : 1997) 24:27-36 (2001).

Mihardja, et al., "Targeted in vivo extracellular matrix formation promotes neovascularization in a rodent model of myocardial infarction," PLoS One, 5(4):e10384 (8 pages), (Apr. 2010).

Mira, et al., "Inhibition of cytosolic phospholipase A2 by annexin V in differentiated permeabilized HL-60 cells. Evidence of crucial importance of domain I type II Ca2+-binding site in the mechanism of inhibition," J. Biol Chem., 272(16):10474-10482, (Apr. 18, 1997).

Miranda, et al., "Endothelium-dependent and -independent hepatic artery vasodilatation is not impaired in a canine model of liver ischemia-reperfusion injury," Braz. J. Med. Biol. Res., 40(6):857-865, (Jun. 2007).

Murray and Brown, "Measurement of association constants in ELISA. Reactions between solid-phase antibody and fluid-phase biotinylated antigen," J. Immunol Methods., 127(1):25-28 (Feb. 20, 1990).

Nedelman, M., et al., "Rapid infarct imaging with a technetium-99m-labeled antimyosin recombinant single-chain Fv: evaluation in a canine model of acute myocardial infarction," J Nucl Med., 34(2):234-241, (Feb. 1993).

Nelson, P., et al. "Characterization of anti-myosin monoclonal antibodies," Hybridoma (Larchmt), 24(6):314-318, (Dec. 2005).

Nimni, "Polypeptide growth factors: targeted delivery systems," Biomaterials, 18(18):1201-1225, (1997).

Nishi, et al., "Collagen-binding growth factors: Production and characterization of functional fusion proteins having a collagen-binding domain," Proc. Natl. Acad. Sci. USA, 95:7018-7023, (Jun. 1998).

Pak, K., et al., "An instant kit method for labeling antimyosin Fab' with technetium-99m: evaluation in an experimental myocardial infarct model," J. Nucl Med., 33(1):144-149, (Jan. 1992).

Peter, K., et al., "Construction and functional evaluation of a single-chain antibody fusion protein with fibrin targeting and thrombin inhibition after activation by factor Xa," Circulation, 101(10):1158-1164, (Mar. 14, 2000).

Pietronave, et al., "Agonist monoclonal antibodies against HGF receptor protect cardiac muscle cells from apoptosis," Am J Physiol Heart circ Physiol, 298:H1155-H1165, (2010).

Prior, et al. "Cytotoxic Activity of a Recombinant Fusion Protein between Insulin-like Growth Factor I and Pseudomonas Exotoxin," Cancer, 174-180 (1991).

Rosenthal, et al., "Growth factor enhancement of cardiac regeneration," Cell Transplantation, 15(1):S41-S45, (2006).

Saxena, et al., "Stromal cell-derived factor-1a is cardioprotective after mocardial infarction," Molecular Cardiology, 2224-2231, (2008).

Schutters, K. & Reutelingsperger, C.P.M. "Phosphatidylserine targeting for diagnosis and treatment of human diseases," Apoptosis : An International Journal on Programmed Cell Death. 15:1072-82, (2010).

Scott, R.C. et al. "Targeted Delivery of Antibody Conjugated Liposomal Drug Carriers to Rat Myocardial Infarction," Biotechnology, 96:795-802, (2007).

Scott, et al. "Aiming for the heart: targeted delivery of drugs to diseased cardiac tissue," Expert Opinion on Drug Delivery, 5:459-70, (2008).

Scott, R.C. et al. "Targeting VEGF-encapsulated immunoliposomes to MI heart improves vascularity and cardiac function". The FASEB Journal : Official Publication of the Federation of American Societies for Experimental Biology, 23:3361-7, (2009).

Segers, et al., "Protein therapeutics for cardiac regeneration after myocradial infarction," J. of Cardiovasc. Trans. Res., 9 pages, (Jul. 7, 2010).

Shan, et al., "Overexpression of TRPC3 increases apoptosis but not necrosis in response to ischemia-reperfusion in adult mouse cardiomyocytes," Am. J. Physiol. Cell. Physiol., 294(3):833-841, (Mar. 2008).

Shin, S.U. & Morrison, S.L., "Expression and characterization of an antibody binding specificity joined to insulin-like growth factor 1: potential applications for cellular targeting," Proceedings of the National Academy of Sciences of the United States of America, 87:5322-6, (1990).

Shin, et al. "Functional properties of antibody insulin-like growth factor fusion proteins," The Journal of Biological Chemistry, 269: 4979-8,5 (1994).

Simeonova, P., et al., "Identification of human ventricular myosin heavy chain fragments with monoclonal antibody 2F4 in human sera after myocardial necrosis," Clin Chim Acta., 201(3):207-221, (Sep. 30, 1991).

Stokes, et al., "A simple, rapid ELISA method for the detection of DNA antibodies," J. Clin. Pathol., 35(5):566-573, (May 1982).

Suleiman, et al., "Apoptosis and the cardiac action of insulin-like growth factor I," Pharmacology and Therapeutics, 114:278-294, (2007).

Sutton, R., et al., " Structure of the first C2 domain of synaptotagmin I. A novel Ca2+/phospholipid-binding fold," Cell, 80(6):929-938, (Mar. 24, 1995).

Ueda, et al., "A potential cardioprotective role of hepatocyte growth factor in myocardial infarction in rats," Cardiovascular Research, 51:41-50, (2001).

Umeda, M., et al., "Effective production of monoclonal antibodies against phosphatidylserine: stereo-specific recognition of phosphatidylserine by monoclonal antibody," J Immunol., 143(7):2273-2279, (Oct. 1, 1989).

Ungethum, et al., "Engineered annexin A5 variants have impaired cell entry for molecular imaging of apoptosis using pretargeting strategies," J Biol Chem., 286(3):1903-10. Epub Nov. 15, 2010 (Jan. 21, 2011).

Urbanek K et al., "Myocardial regeneration by activation of multipotent cardiac stem cells in ischemic heart failure," Proc. Natl. Acad. Sci. USA, 102(24):8692-8697, (Jun. 14, 2005).

(56) References Cited

OTHER PUBLICATIONS

Wang, et al., "Degradable PLGA scaffolds with basic fibroblast growth factor," Texas Heart Institute Journal, 89-97, (2009).
Wassaf, et al., "High-throughput affinity ranking of antibodies using surface plasmon resonance microarrays," Anal. Biochem., 351(2):241-253, (Apr. 15, 2006).
Winter, et al. "A new bioassay for the immunocytokine L19-IL2 for simultaneous analysis of both functional moieties," Journal of Pharmaceutical and Biomedical Analysis, 54:81-6 (2011).
Yang L. et al., "Human cardiovascular progenitor cells develop from a KDR+ embryonic-stem-cell-derived population", Nature. May 22, 2008;453(7194):524-8. Epub Apr. 23, 2008.
Yeghiazarians, et al., "Injection of bone marrow cell extract into infarcted hearts results in functional improvement comparable to intact cell therapy," The American Society of Gene Therapy, 17(7):1250-1256, (Jul. 2009).
Zaruba, et al., "Synergy between CD26/DPP-IV inhibition and G-CSF improves cardiac function after acute myocardial infarction," Cell Stem Cell, 4:313-323, (Apr. 3, 2009).
Zbinden, et al., "Interanimal variability in preexisting collaterals is a major factor determining outcome in experimental angiogenesis trials," Am. J. Physiol. Heart Circ. Physiol., 292(4): H1891-H1897, (Apr. 2007).
Zentilin, et al., "Cardiomyocyte VEGFR-1 activation by VEGF-B induces compensatory hypertrophy and preserves cardiac function after myocardial infarction," The FASEB Journal, 24:1467-1478, (May 2010).
Zhang, J. et al. "Collagen-targeting vascular endothelial growth factor improves cardiac performance after myocardial infarction," Circulation, 119:1776-84, (2009).
Zhao, et al., "Neuregulins promote survival and growth of cardiac myocytes," The Journal of Biological Chemistry, 273(17):0261-10269, (Apr. 24, 1998).
Zhao, et al., "Recruitment of endogenous stem cells for tissue repair," Macromolecular Bioscience, 8:836-842, (2008).
International Search Report based on PCT/2011/037459, mailed Aug. 30, 2011.
Stamm et al. Human ortholog to mouse gene imap38 encoding an ER-localized G-protein belongs to the a gene family clustered on chromosome 7q32-36, Gene vol. 282:159-167, 2003.
Office Action for U.S. Appl. No. 13/112,907 mailed Aug. 1, 2013.
Tuan et al. "Engineering, expression and renaturation of targeted TGF-beta fusion proteins"; Connect Tissue Res. 1996;34(1):1-9.
Ziegler M et al. "The bispecific SDF1-GPVI fusion protein preserves myocardial function after transient ischemia in mice" Circulation. Feb. 7, 2012;125(5):685-96. doi: 10.1161/CIRCULATION.111.070508. Epub Jan. 5, 2012.
Office Action for U.S. Appl. No. 13/112,907 mailed Mar. 15, 2013.

\* cited by examiner

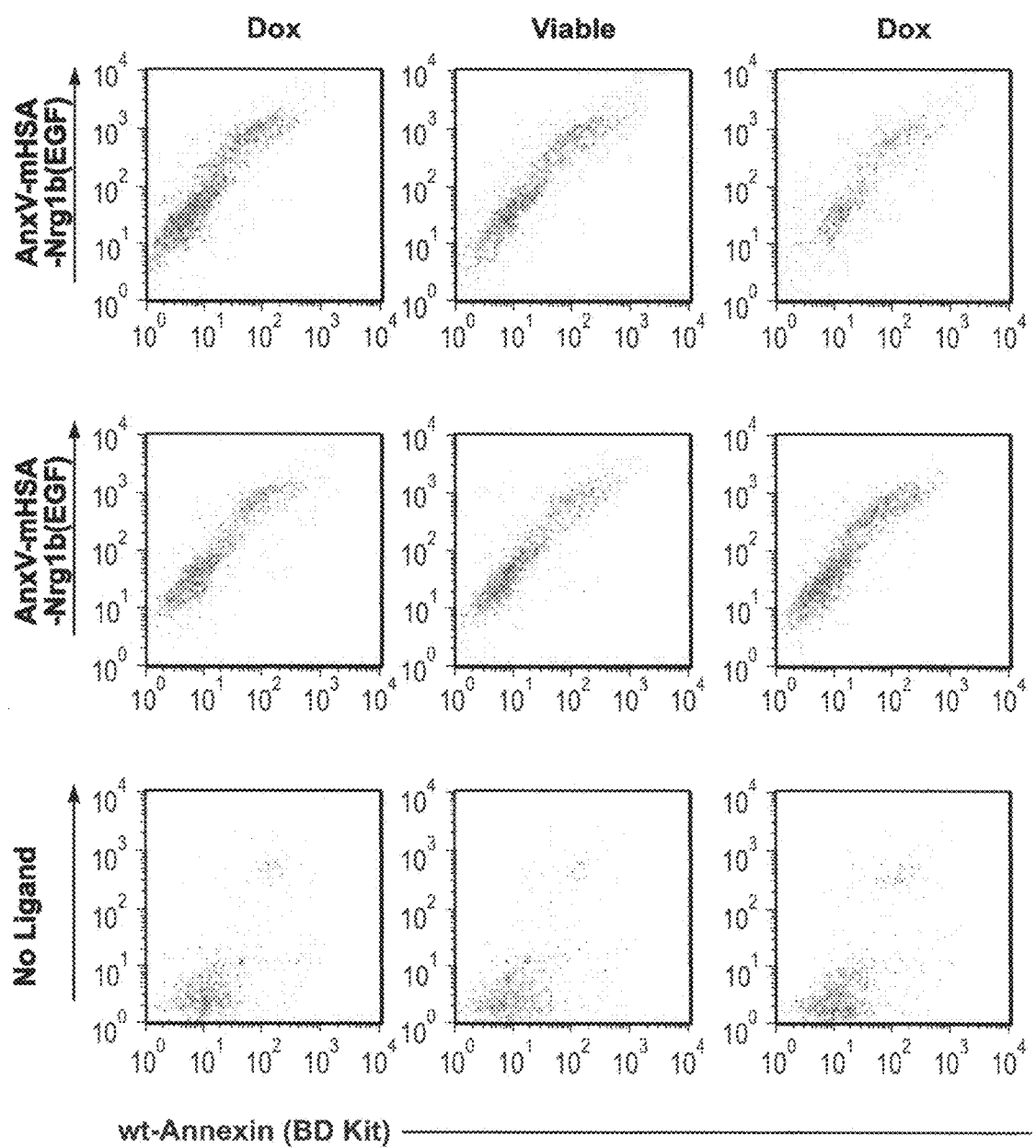

| Leader polypeptide (optional) | = | Targeting polypeptide domain | = | Short Connector Polypeptide (optional) | = | Half-Life Modulator | = | Short Connector Polypeptide (optional) | = | Activator domain | = | polyhistidine comprising polypeptide (optional) |

FIG. 33A

| Leader polypeptide (optional) | = | Activator domain | = | Short Connector Polypeptide (optional) | = | Half-Life Modulator | = | Short Connector Polypeptide (optional) | = | Targeting polypeptide domain | = | polyhistidine comprising polypeptide (optional) |

FIG. 33B

| Leader polypeptide (optional) | = | Half-Life Modulator | = | Short Connector Polypeptide (optional) | = | Targeting polypeptide domain | = | Short Connector Polypeptide (optional) | = | Activator domain | = | polyhistidine comprising polypeptide (optional) |

FIG. 33C

| Leader polypeptide (optional) | = | Half-Life Modulator | = | Short Connector Polypeptide (optional) | = | Activator domain | = | Short Connector Polypeptide (optional) | = | Targeting polypeptide domain | = | polyhistidine comprising polypeptide (optional) |

FIG. 33D

| Leader polypeptide (optional) | = | Targeting polypeptide domain | = | Short Connector Polypeptide (optional) | = | Activator domain | = | Short Connector Polypeptide (optional) | = | Half-Life Modulator | = | polyhistidine comprising polypeptide (optional) |

FIG. 33E

| Leader polypeptide (optional) | = | Activator domain | = | Short Connector Polypeptide (optional) | = | Targeting polypeptide domain | = | Short Connector Polypeptide (optional) | = | Half-Life Modulator | = | polyhistidine comprising polypeptide (optional) |

FIG. 33F

BI-SPECIFIC FUSION PROTEINS

RELATED APPLICATIONS

This application claims the benefit of and priority to U.S. Provisional Application Ser. No. 61/347,040, filed May 21, 2010, which application is incorporated herein by reference in its entirety. Reference is also made to co-pending U.S. application Ser. No. 13/112,907, filed May 20, 2011, now U.S. Pat. No. 8,691,771, which is incorporated herein by reference.

REFERENCE TO SEQUENCE LISTING

This specification includes a sequence listing provided on a compact disc, submitted herewith, which includes the file entitled 132463-010104_ST25.txt having the following size: 961,000 bytes which was created May 20, 2011, the contents of which are incorporated by reference herein.

TECHNICAL FIELD

The present invention relates generally to fusion proteins that have therapeutic uses, and more specifically to bi-specific fusion proteins, pharmaceutical compositions comprising such fusion proteins, and methods for using such fusion proteins to repair damaged tissue.

BACKGROUND

Tissue regeneration is a multidisciplinary science in which the goal is to restore biological function of diseased or damaged tissues. Tissue regeneration addresses major clinical problems such as myocardial infarction. Myocardial infarction, commonly known as a heart attack, occurs when coronary artery obstruction cuts off the blood supply to part of the heart. The resulting lack of oxygen causes irreversible tissue damage (necrosis and apoptosis), due to the inability of the heart to sufficiently activate endogenous regeneration programs and self-repair. Such tissue damage is a leading cause of congestive heart failure, a condition in which the heart is no longer capable of effectively pumping blood. In the United States, there are more than a million heart attacks every year, and nearly 5 million people are afflicted with congestive heart failure.

There are no effective treatments for regenerating damaged cardiac tissue. Current therapies for congestive heart failure focus on preventing arrhythmia, progression of arteriosclerosis and recurrent myocardial infarction, but do not address the underlying tissue damage. More than half of patients diagnosed with congestive heart failure die within five years of diagnosis.

Stem cell therapy is a potential new strategy for cardiac repair. In the laboratory, it is possible to generate cardiac muscle cells from stem cells. This suggests that stems cells could be used to repair damaged tissue such as cardiac tissue in a patient; however, no therapeutic treatments based on such an approach are presently available. One difficulty that has been encountered in stem cell therapy is that of targeting sufficient numbers of stem cells to the damaged tissue to result in clinically significant repair.

There is, thus, a need in the art for methods for repairing or regenerating damaged tissues, and for improving the targeting of cells such as stem cells to facilitate tissue repair. The present invention fulfills these needs, and provides other related advantages.

SUMMARY OF THE INVENTION

The present invention provides bi-specific fusion proteins, nucleic acid molecules encoding bi-specific fusion proteins and therapeutic methods that employ such bi-specific fusion proteins. In certain aspects, the present invention provides bi-specific fusion proteins that comprise: (a) a targeting domain having a binding specificity to a target molecule associated with a damaged cell of a tissue, wherein the molecule is intracellular in a viable cell and exposed to the extracellular space in the damaged cell; and (b) an activator domain having a binding specificity to a growth factor receptor associated with a surface of a cell in the tissue, wherein upon exposure of the activator domain to the growth factor receptor, the activator domain binds the growth factor receptor so as to modulate regeneration or survival of the tissue. In some embodiments, the bi-specific protein further comprises a peptide half life modulator.

In certain aspects of the invention, the bi-specific fusion protein comprises (a) a targeting domain having a binding specificity to a target molecule associated with a damaged cell of a tissue, wherein the molecule is intracellular in a viable cell and exposed to the extracellular space in the damaged cell; (b) an activator domain having a binding specificity to a molecule associated with the surface of a cell in the tissue, wherein upon exposure of the activator domain to surface-associated molecule, the activator domain binds the surface-associated molecule so as to modulate regeneration or survival of the tissue; and (c) a half life modulator wherein the half life modulator modulates the half life of the bi-specific fusion protein.

In other aspects of the invention, the bi-specific fusion protein comprises (a) a targeting domain having a binding specificity to a target molecule associated with a tissue; (b) an activator domain having a binding specificity to a molecule associated with the surface of a cell in the tissue, wherein upon exposure of the activator domain to the molecule, the activator domain binds the molecule so as to modulate regeneration or survival of the tissue; and (c) a half life modulator wherein the half life modulator modulates the half life of the bi-specific fusion protein.

In other aspects of the invention, the bi-specific fusion protein comprises (a) a targeting domain having a binding specificity to a target molecule associated with a tissue; (b) a binding domain having a binding specificity to a molecule associated with the surface of a cell in the tissue, wherein upon exposure of the binding domain to the molecule, the binding domain binds the molecule so as to promote regeneration or survival of the tissue; and (c) a half life modulator wherein the half life modulator modulates the half life of the bi-specific fusion protein.

Yet other aspects of the invention relate to a fusion protein comprising (a) at least one targeting domain having a binding specificity to at least one target molecule associated with a tissue; (b) at least one activator domain having a binding specificity to at least one molecule associated with the surface of a cell in the tissue, wherein upon exposure of the activator domain to the molecule, the activator domain binds the molecule so as to promote regeneration or survival of the tissue; and (c) a half life modulator wherein the half life modulator modulates the half life of the fusion protein.

In some embodiments, the activator domain or the binding domain binds specifically to a growth factor receptor, cytokine receptor or stem cell-associated antigen. In some embodiments, the targeting domain does not have a biological activity. The targeting domain and the activator domain can bind different molecules on a same cell or can bind different molecules on different cells.

In some embodiments, the activator domain is selected from the group consisting of: fibroblast growth factor (FGF), epidermal-growth factor (EGF), neuregulin/heregulin (NRG/HRG), insulin-like growth factor (IGF), hepatocyte growth factor (HGF), thymosin, granulocyte colony stimulating factor (G-CSF), stem cell factor (SCF)/mast cell growth factor (MGF), periostin, vascular endothelial growth factor (VEGF), stromal cell-derived factor (SDF), platelet-derived growth factor (PDGF), tetracarcinoma-derived growth factor (TDGF), beta-nerve growth factor (NGF), brain-derived neurotrophic factor (BDNF), neurotrophin-3 (NT-3), thrombopoietin (TPO), bone morphogenic protein (BMP), activin A, betacellulin, beta-catenin, dickkopf homolog 1 (DKK1), erythropoietin (EPO), growth hormone (GH), heparin-binding EGF-like growth factor (HBEGF), insulin, interleukin (IL) leukemia inhibitory factor (LIF), monocyte chemotactic protein 1 (MCP1/CCL2), pleiotrophin (PTN), transforming growth factor (TGF), tumor necrosis factor (TNF), Wnt, an antibody having a specificity for an activator receptor, variants thereof, isoforms thereof, fragments thereof, and combinations thereof. In some embodiments, the activator domain comprises a sequence recited in any one of SEQ ID NOs: 3-9, 32-40, or 50-64.

The targeting domain can be at the amino terminus and the activator domain at the carboxy terminus of the fusion protein. In some embodiments, the targeting domain is at the carboxy terminus and the activator domain is at the amino terminus of the fusion protein. In some embodiments, the targeting domain is at the carboxy terminus and the activator domain is at the amino terminus of the fusion protein.

In some embodiments, the half life modulator is a non-immunogenic protein. The half life modulator can comprise a sequence from one of human serum albumin, domain III of human serum albumin, alpha-fetoprotein, vitamin D-binding protein, transthyretin antibody Fc domain, single-chain version of antibody Fc domain, proline-, alanine-, and/or serine-rich sequences, variants thereof, fragments thereof, and combinations thereof. For example, the half life modulator comprises at least 100 consecutive amino acids that are at least 80% identical to a serum albumin amino acid sequence. In some embodiments, the half life modulator has an amino acid sequence recited in any one of SEQ ID NOs: 10, 12, 14-29, 45-49, 65-71 or 105.

In some embodiments, the targeting domain binds to a target molecule selected from the group of myosin, cardiac myosin, DNA, phosphatidylserine, P-selectin, ICAM-1, c-Met (HGF receptor), variants thereof, fragments thereof, and combinations thereof. In some embodiments, the targeting domain binds to the target molecule with a dissociation constant Kd ranging from $10^{-6}$ M to $10^{-12}$ M. The targeting domain can be selected from the group of annexin, synaptotagmin, anti-phosphatidylserine antibody, PS4A7, lactadherin, anti-myosin antibody, anti-DNA antibody, aDNASI1, aDNASI22, variants thereof, fragments thereof, and combinations thereof. In some embodiments, the targeting domain has a sequence recited in any one of SEQ ID NOs: 1-2, 30-31, 72-73, 76-83 or 85-86. In some embodiments, the antibody is a scFv antibody having a sequence recited in any one of SEQ ID NOs: 1, 2, 30, 73, 76-80. In some embodiments, annexin is annexin V and has sequence recited in SEQ ID. NOs 31, 81, 82 or 83. In some embodiments, the targeting domain comprises a sequence recited in any one of SEQ ID NOs: 1, 2, 30, 31 or 72-86.

In some embodiments, the bi-specific fusion protein further comprises a connector linking the half-life modulator to the fusion protein. The bi-specific fusion protein can exhibit an in vivo half-life of between 2 hours and 6 hours, between 6 hours and 24 hours, greater than 24 hours, or greater than one week.

In some embodiments, the fusion protein promotes cell recruitment, inhibition of apoptosis and/or induction of cell proliferation. In some embodiments, the fusion protein prevents cell damage, promotes cell growth, promotes motility of stem cells, and/or promotes differentiation of stem cells. In some embodiments, the fusion protein promotes tissue regeneration. The tissue can be a cardiac tissue, kidney tissue, bone, cartilage, joints, skin, liver tissue, pancreatic tissue, blood cells, lung tissue, or nervous system.

In some embodiments, the fusion protein further comprises a leader polypeptide. The leader polypeptide can comprise a sequence recited in any one of SEQ ID NOs: 41, 42, 87-91 or 244.

In some embodiments, the fusion protein further comprises polypeptide affinity tag. In some embodiments, the affinity tag is at the amino terminus of the fusion protein, at the carboxy terminus of the fusion protein, or in the middle of the fusion protein. In some embodiments, the fusion protein comprises a hexahistidine-comprising polypeptide. The hexahistidine-comprising polypeptide can have a sequence recited in any one of SEQ ID NOs: 43, 44, or 92-94.

The bi-specific binding agents provided herein are not necessarily limited to two binding specificities. In certain embodiments, in addition to the targeting domain, the bi-specific fusion protein comprises two or more activator domains that are linked directly or indirectly via peptide bonds. In certain embodiments, in addition to the activator domain, the bi-specific fusion protein comprises two or more targeting domains that are linked directly or indirectly via peptide bonds.

In other aspects, the present invention provides pharmaceutical compositions, comprising a bi-specific fusion protein as described above in combination with a physiologically acceptable carrier.

Within still further aspects, methods are provided for treating pathological tissue damage in a patient, comprising administering a pharmaceutical composition to a patient suffering from pathological tissue damage, and thereby decreasing pathological tissue damage in the patient.

Aspects of the invention relate to a method of promoting tissue regeneration or survival in a subject, the method comprising (a) providing a bi-specific fusion protein comprising (i) a targeting domain having a binding specificity to a target molecule associated with a damaged cell of a tissue, wherein the molecule is intracellular in a viable cell and exposed to the extracellular space in the damaged cell; and (ii) an activator domain having a binding specificity to growth factor receptor; and (b) administering in a patient in need thereof a therapeutically effective amount of the bi-specific fusion protein whereby the targeting domain specifically binds to the target molecule associated with the damaged cell of the tissue thereby targeting the bi-specific fusion protein to a first cell of the tissue and whereby upon exposure of the activator domain to the growth factor receptor, the activator domain specifically activates the growth factor receptor of a second cell so as to promote tissue regeneration.

In some embodiments, the method of promoting tissue regeneration or survival in a subject comprises (a) providing a bi-specific fusion protein comprising (i) a targeting domain having a binding specificity to a target molecule; (ii) an activator domain having a binding specificity to a receptor; (iii) a half life modulator, wherein the half life modulator modulates the half life of the bi-specific fusion protein; and (b) administering in a patient in need thereof a therapeutically effective amount of the bi-specific fusion protein whereby the targeting domain specifically binds to the target molecule thereby targeting the bi-specific fusion protein to a first cell of a tissue and whereby upon exposure of the activator domain to the growth factor receptor, the activator domain specifically activates the receptor of a second cell of the tissue so as to promote tissue regeneration.

In some embodiments, the first and second cells are the same. Yet in other embodiments, the first and second cells are different. In some embodiments, the first cell is a viable cell and the second cell is a damaged cell. Yet in other embodiments, the first cell is a damaged cell and the second cell is a viable cell. In some embodiments, the method further comprises administering stem cells to the patient.

In certain embodiments, the pathological tissue damage is heart tissue damage associated with myocardial infarction. In other embodiments, the pathological tissue damage is kidney tissue damage. In other embodiments, the pathological tissue damage is in bone, cartilage, joints, skin, liver tissue, pancreatic tissue, blood cells, lung tissue, or nervous system. In certain embodiments, such methods further comprise the administration of stem cells to the patient.

Also provided herein are nucleic acid molecules encoding a bi-specific fusion protein as described above. In certain embodiments, the nucleic acid molecule is DNA, and the DNA further comprises transcriptional and translational regulatory sequences operably linked to the bi-specific fusion protein coding sequence, such that transcription and translation of the coding sequence occurs in at least one eukaryotic cell type.

These and other aspects of the present invention will become apparent upon reference to the following detailed description.

DESCRIPTION OF THE SEQUENCE LISTING

SEQ ID NO:1 is the amino acid sequence of the anti-DNA scFv SI-1.

SEQ ID NO:2 is the amino acid sequence of the anti-DNA scFv SI-22.

SEQ ID NO:3 is the amino acid sequence of a growth factor polypeptide corresponding to wild type human IGF-I (mature form).

SEQ ID NO:4 is the amino acid sequence of a growth factor polypeptide corresponding to human IGF-1 with D12A substitution.

SEQ ID NO:5 is the amino acid sequence of a growth factor polypeptide corresponding to human IGF-1 with E9A substitution.

SEQ ID NO:6 is the amino acid sequence of a growth factor polypeptide corresponding to human HGF alpha chain N-K1 domain.

SEQ ID NO:7 is the amino acid sequence of a growth factor polypeptide corresponding to human HGF alpha chain K1 domain.

SEQ ID NO:8 is the amino acid sequence of a growth factor polypeptide corresponding to human HGF alpha chain N-K2 fusion.

SEQ ID NO:9 is the amino acid sequence of a growth factor polypeptide corresponding to human HGF alpha chain K2 domain.

SEQ ID NO:10 is the amino acid sequence of a human serum albumin (HSA) linker with C34S and N503Q substitutions.

SEQ ID NO:11 is the nucleic acid sequence of an HSA linker with C34S and N503Q substitutions.

SEQ ID NO:12 is the amino acid sequence of HSA.

SEQ ID NO:13 is the nucleic acid sequence of HSA.

SEQ ID NO:14 is the amino acid sequence of an HSA linker with C34S and N503Q substitutions and a polypeptide connector.

SEQ ID NO:15 is the amino acid sequence of an HSA linker with C34S and N503Q substitutions and a polypeptide connector.

SEQ ID NO:16 is the amino acid sequence of an HSA linker with C34S and N503Q substitutions and a polypeptide connector.

SEQ ID NO:17 is the amino acid sequence of an HSA linker with C34S and N503Q substitutions and a polypeptide connector.

SEQ ID NO:18 is the amino acid sequence of an HSA linker with C34S and N503Q substitutions and a polypeptide connector.

SEQ ID NO:19 is the amino acid sequence of an HSA linker with a polypeptide connector.

SEQ ID NO:20 is the amino acid sequence of an HSA linker with a polypeptide connector.

SEQ ID NO:21 is the amino acid sequence of an HSA linker with a polypeptide connector.

SEQ ID NO:22 is the amino acid sequence of an HSA linker with a polypeptide connector.

SEQ ID NO:23 is the amino acid sequence of an HSA linker with a polypeptide connector.

SEQ ID NO:24 is the amino acid sequence of an HSA linker with C34S substitution, domain I.

SEQ ID NO:25 is the amino acid sequence of an HSA linker, domain II.

SEQ ID NO:26 is the amino acid sequence of an HSA linker with N503Q substitution, domain III.

SEQ ID NO:27 is the amino acid sequence of an HSA linker, domain I.

SEQ ID NO:28 is the amino acid sequence of an HSA linker, domain III.

SEQ ID NO:29 is the amino acid sequence of human alpha-fetoprotein.

SEQ ID NO:30 is the amino acid sequence of the anti-phosphatidylserine scFv PS4A7.

SEQ ID NO:31 is the amino acid sequence of human annexin V (AnxV).

SEQ ID NO:32 is an amino acid sequence of a growth factor polypeptide corresponding to human HGF alpha chain N-K1 domain.

SEQ ID NO:33 is an amino acid sequence of a growth factor polypeptide corresponding to human HGF alpha chain K1 domain.

SEQ ID NO:34 is an amino acid sequence of a growth factor polypeptide corresponding to human HGF alpha chain N-K2 domain.

SEQ ID NO:35 is an amino acid sequence of a growth factor polypeptide corresponding to human HGF alpha chain K2 domain.

SEQ ID NO:36 is an amino acid sequence of a growth factor polypeptide corresponding to human VEGF alpha monomer.

SEQ ID NO:37 is an amino acid sequence of a growth factor polypeptide corresponding to human VEGF alpha dimer.

SEQ ID NO:38 is an amino acid sequence of a growth factor polypeptide corresponding to human FGF2.

SEQ ID NO:39 is an amino acid sequence of a growth factor polypeptide corresponding to human NRG1 alpha, EGF-like domain.

SEQ ID NO:40 is an amino acid sequence of a growth factor polypeptide corresponding to human NRG1 alpha, full sequence.

SEQ ID NO:41 is an amino acid sequence of a bi-specific fusion protein leader polypeptide.

SEQ ID NO:42 is an amino acid sequence of a bi-specific fusion protein leader polypeptide.

SEQ ID NO:43 is an amino acid sequence of a C-terminal hexahistidine-comprising polypeptide.

SEQ ID NO:44 is an amino acid sequence of a C-terminal hexahistidine-comprising polypeptide.

SEQ ID NO:45 is an amino acid sequence of a HSA linker.

SEQ ID NO:46 is an amino acid sequence of a HSA linker with N-terminal and C-terminal short connector polypeptides.

SEQ ID NO:47 is an amino acid sequence of a HSA linker with N-terminal and C-terminal short connector polypeptides.

SEQ ID NO:48 is an amino acid sequence of a HSA linker with N-terminal and C-terminal short connector polypeptides.

SEQ ID NO:49 is an amino acid sequence of a HSA linker with N-terminal and C-terminal short connector polypeptides.

SEQ ID NO: 50 is an amino acid sequence of a variant of a growth factor polypeptide corresponding to human FGF2.

SEQ ID NO: 51 is an amino acid sequence of a growth factor polypeptide corresponding to human HGF alpha chain.

SEQ ID NO: 52 is an amino acid sequence of a growth factor polypeptide corresponding to human HGF alpha chain K1 domain.

SEQ ID NO: 53 is an amino acid sequence of a growth factor polypeptide corresponding to human HGF alpha chain N-K2 domain.

SEQ ID NO: 54 is an amino acid sequence of a growth factor polypeptide corresponding to human HGF alpha chain K2 domain.

SEQ ID NO: 55 is an amino acid sequence of a growth factor polypeptide corresponding to human NRG1 beta extracellular domain.

SEQ ID NO: 56 is an amino acid sequence of a growth factor polypeptide corresponding to human NRG1 beta EGF like domain.

SEQ ID NO: 57 is an amino acid sequence of human full length periostin.

SEQ ID NO: 58 is an amino acid sequence of a region of human periostin.

SEQ ID NO: 59 is an amino acid sequence of a growth factor polypeptide corresponding to human bone morphogenetic protein-2.

SEQ ID NO 60 is an amino acid sequence of a growth factor polypeptide corresponding to a single chain human bone morphogenetic protein-2.

SEQ ID NO 61 is an amino acid sequence of a growth factor polypeptide corresponding to vascular endothelial growth factor B.

SEQ ID NO 62 is an amino acid sequence of part of the human vascular endothelial growth factor B.

SEQ ID NO 63 is an amino acid sequence of part of the human vascular endothelial growth factor B.

SEQ ID NO 64 is an amino acid sequence of part of the human vascular endothelial growth factor B.

SEQ ID NO 65 is an amino sequence of domain III of Human Serum Albumin (HSA).

SEQ ID NO 66 is an amino acid sequence of a modified Vitamin D Binding Protein (mVDBP).

SEQ ID NO 67 is an amino sequence of domain III of a modified Human Serum Albumin.

SEQ ID NO 68 is an amino sequence of human AFP.

SEQ ID NO 69 is an amino sequence of a modified AFP.

SEQ ID NO 70 is an amino acid sequence of the albumin-binding domain human antibody (albudAb).

SEQ ID NO 71 is an amino acid sequence of is a monomeric variant form of Fc, named scFc.

SEQ ID NO 72 is an amino acid sequence of synaptotagmin I.

SEQ ID NO 73 is an amino acid sequence of an anti-DNA scFv antibody.

SEQ ID NO 74 is an amino acid sequence of a non-binding synaptotagmin I variant.

SEQ ID NO 75 is an amino acid sequence of a non-binding scFv variant (DAscFv).

SEQ ID NO 76 is an amino acid sequence of B7scFv anti-myosin scFv antibody.

SEQ ID NO 77 is an amino acid sequence of FD2 anti-myosin scFv antibody.

SEQ ID NO 78 is an amino acid sequence of MCA1 anti-myosin scFv antibody.

SEQ ID NO 79 is an amino acid sequence of MCB11 anti-myosin scFv antibody.

SEQ ID NO 80 is an amino acid sequence of S3F5 anti-myosin scFv antibody.

SEQ ID NO 81 is an amino acid sequence of a variant of human annexin V (AnxVmC315S).

SEQ ID NO 82 is an amino acid sequence of a variant of human annexin V (AnxVm3).

SEQ ID NO 83 is an amino acid sequence of a variant of human annexin V (AnxVm23).

SEQ ID NO 84 is an amino acid sequence of a non-binding variant of human annexin V (AnxVm1234).

SEQ ID NO 85 is an amino acid sequence of a variant of lactadherin.

SEQ ID NO 86 is an amino acid sequence of a variant of lactadherin.

SEQ ID NO 87 is an amino acid sequence of alpha mating factor.

SEQ ID NO 88 is an amino acid sequence of app8 leader polypeptide.

SEQ ID NO 89 is an amino acid sequence aga2 signal peptide.

SEQ ID NO 90 is an amino acid sequence SUC2 signal peptide.

SEQ ID NO 91 is an amino acid sequence a synthetic signal peptide.

SEQ ID NO 92 is an amino acid sequence of a hexahistidine tag.

SEQ ID NO 93 is an amino acid sequence of a hexahistidine tag.

SEQ ID NO 94 is an amino acid sequence of a hexahistidine tag.

SEQ ID NOs 95 to 104, and SEQ ID NO 182 to 184 correspond to amino acid sequence of a polypeptide linker.

SEQ ID NO 105 is an amino acid sequence of the proline-, alanine-, and/or serine-rich sequence.

SEQ ID NO 106 is an amino acid sequence of the aDNASI1_mHSA_IGF1 fusion protein. SEQ ID NO 107 is a nucleic acid sequence of the aDNASI1_mHSA_IGF1 fusion protein.

SEQ ID NO 108 is an amino acid sequence of the aPS4A7_mHSA_IGF1 fusion protein. SEQ ID NO 109 is a nucleic acid sequence of the of the aPS4A7_mHSA_IGF1 fusion protein.

SEQ ID NO 110 is an amino acid sequence of the aDNASI1_mHSA_HGF(NK1) fusion protein. SEQ ID NO 111 is a nucleic acid sequence of the aDNASI1_mHSA_HGF(NK1) fusion protein.

SEQ ID NO 112 is an amino acid sequence of the aPS4A7_mHSA_HGF(NK1) fusion protein. SEQ ID NO 113 is a nucleic acid sequence of the aPS4A7_mHSA_HGF(NK1) fusion protein.

SEQ ID NO 114 is an amino acid sequence of the AnxVm1234_mHSA_IGF1 fusion protein. SEQ ID NO 115 is a nucleic acid sequence of the AnxVm1234_mHSA_IGF1 fusion protein.

SEQ ID NO 116 is an amino acid sequence of the AnxVm1234_mHSA_NRG1b(EGF) fusion protein. SEQ ID NO 117 is a nucleic acid sequence of the AnxVm1234_mHSA_NRG1b(EGF) fusion protein.

SEQ ID NO 118 is an amino acid sequence of the AnxV_mHSA_FGF2 fusion protein. SEQ ID NO 119 is a nucleic acid sequence of the AnxV_mHSA_FGF2 fusion protein.

SEQ ID NO 120 is an amino acid sequence of the AnxV_mHSA_NRG1b(EGF) fusion protein. SEQ ID NO 121 is a nucleic acid sequence of the AnxV_mHSA_NRG1b(EGF) fusion protein.

SEQ ID NO 122 is an amino acid sequence of the FGF2_mHSA_AnxVm1234 fusion protein. SEQ ID NO 123 is a nucleic acid sequence of the FGF2_mHSA_AnxVm1234 fusion protein.

SEQ ID NO 124 is an amino acid sequence of the aDNASI1_mHSA_FGF2 fusion protein. SEQ ID NO 125 is a nucleic acid sequence of the aDNASI1_mHSA_FGF2 fusion protein.

SEQ ID NO 126 is an amino acid sequence of the aDNASI1_mHSA_NRG1b(EGF) fusion protein. SEQ ID NO 127 is a nucleic acid sequence of the aDNASI1_mHSA_NRG1b(EGF) fusion protein.

SEQ ID NO 128 is an amino acid sequence of the AnxV_mHSA_VEGFB(111) fusion protein. SEQ ID NO 129 is a nucleic acid sequence of the AnxV_mHSA_VEGFB(111) fusion protein.

SEQ ID NO 130 is an amino acid sequence of the AnxV_mHSA_VEGFB(167) fusion protein. SEQ ID NO 131 is a nucleic acid sequence of the AnxV_mHSA_VEGFB(167) fusion protein.

SEQ ID NO 132 is an amino acid sequence of the AnxV_mHSA_HGF(NK1) fusion protein. SEQ ID NO 133 is a nucleic acid sequence of the AnxV_mHSA_HGF(NK1) fusion protein.

SEQ ID NO 134 is an amino acid sequence of the AnxV_mHSA_IGF1 fusion protein. SEQ ID NO 135 is a nucleic acid sequence of the AnxV_mHSA_IGF1 fusion protein.

SEQ ID NO 136 is an amino acid sequence of the IGF1_mHSA_AnxV fusion protein. SEQ ID NO 137 is a nucleic acid sequence of the IGF1_mHSA_AnxV fusion protein.

SEQ ID NO 138 is an amino acid sequence of the IGF1_mHSA_AnxVm1234 fusion protein. SEQ ID NO 139 is a nucleic acid sequence of the IGF1_mHSA_AnxVm1234 fusion protein.

SEQ ID NO 140 is an amino acid sequence of the HGF(NK1)_mHSA_AnxV fusion protein. SEQ ID NO 141 is a nucleic acid sequence of the HGF(NK1)_mHSA_AnxV fusion protein.

SEQ ID NO 142 is an amino acid sequence of the NRG1b(EGF)_mHSA_AnxV fusion protein. SEQ ID NO 143 is a nucleic acid sequence of the NRG1b(EGF)_mHSA_AnxV fusion protein.

SEQ ID NO 144 is an amino acid sequence of the FGF2_mHSA_AnxV fusion protein. SEQ ID NO 145 is a nucleic acid sequence of the FGF2_mHSA_AnxV fusion protein.

SEQ ID NO 146 is an amino acid sequence of the VEGFB(167)_mHSA_AnxV fusion protein. SEQ ID NO 14 is a nucleic acid sequence of the VEGFB(167)_mHSA_AnxV fusion protein.

SEQ ID NO 148 is an amino acid sequence of the VEGFB(111)_mHSA_AnxV fusion protein. SEQ ID NO 149 a nucleic acid sequence of the VEGFB(111)_mHSA_AnxV fusion protein.

SEQ ID NO 150 is an amino acid sequence of the IGF1_mHSA_B7scFv fusion protein. SEQ ID NO 151 is a nucleic acid sequence of the IGF1_mHSA_B7scFv fusion protein.

SEQ ID NO 152 is an amino acid sequence of the IGF1_mHSA_Syt1 fusion protein. SEQ ID NO 153 is a nucleic acid sequence of the IGF1_mHSA_Syt1 fusion protein.

SEQ ID NO 154 is an amino acid sequence of the IGF1_mHSA_aDNASI1 fusion protein. SEQ ID NO 155 is a nucleic acid sequence of the IGF1_mHSA_aDNASI1 fusion protein.

SEQ ID NO 156 is an amino acid sequence of the NRG1b(EGF)_mHSA_B7scFv fusion protein. SEQ ID NO 157 is a nucleic acid sequence of the NRG1b(EGF)_mHSA_B7scFv fusion protein.

SEQ ID NO 158 is an amino acid sequence of the NRG1b(EGF)_mHSA_Syt1 fusion protein. SEQ ID NO 159 is a nucleic acid sequence of the NRG1b(EGF)_mHSA_Syt1 fusion protein.

SEQ ID NO 160 is an amino acid sequence of the NRG1b(EGF)_mHSA_aDNASI1 fusion protein. SEQ ID NO 161 is a nucleic acid sequence of the NRG1b(EGF)_mHSA_aDNASI1 fusion protein.

SEQ ID NO 162 is an amino acid sequence of the FGF2_mHSA_B7scFv fusion protein. SEQ ID NO 163 is a nucleic acid sequence of the FGF2_mHSA_B7scFv fusion protein.

SEQ ID NO 164 is an amino acid sequence of the FGF2_mHSA_Syt1 fusion protein. SEQ ID NO 165 is a nucleic acid sequence of the FGF2_mHSA_Syt1 fusion protein.

SEQ ID NO 166 is an amino acid sequence of the FGF2_mHSA_aDNASI1 fusion protein. SEQ ID NO 167 is a nucleic acid sequence of the FGF2_mHSA_aDNASI1 fusion protein.

SEQ ID NO 168 is an amino acid sequence of the B7scFv_mHSA_IGF1 fusion protein. SEQ ID NO 169 is a nucleic acid sequence of the B7scFv_mHSA_IGF1 fusion protein.

SEQ ID NO 170 is an amino acid sequence of the Syt1_mHSA_IGF1 fusion protein. SEQ ID NO 171 is a nucleic acid sequence of the Syt1_mHSA_IGF1 fusion protein.

SEQ ID NO 172 is an amino acid sequence of the aDNASI1_mHSA_IGF1 fusion protein. SEQ ID NO 173 is a nucleic acid sequence of the aDNASI1_mHSA_IGF1 fusion protein.

SEQ ID NO 174 is an amino acid sequence of the B7scFv_mHSA_NRG1b(EGF) fusion protein. SEQ ID NO 175 is a nucleic acid sequence of the B7scFv_mHSA_NRG1b(EGF) fusion protein.

SEQ ID NO 176 is an amino acid sequence of the Syt1_mHSA_NRG1b(EGF) fusion protein. SEQ ID NO 177 is a nucleic acid sequence of the Syt1_mHSA_NRG1b(EGF) fusion protein.

SEQ ID NO 178 is an amino acid sequence of the B7scFv_mHSA_FGF2 fusion protein. SEQ ID NO 179 is a nucleic acid sequence of the B7scFv_mHSA_FGF2 fusion protein.

SEQ ID NO 180 is an amino acid sequence of the Syt1_mHSA_FGF2 fusion protein. SEQ ID NO 181 is a nucleic acid sequence of the Syt1_mHSA_FGF2 fusion protein.

SEQ ID NO 185 is an amino acid sequence of the IGF1_mHSA_DAscFv fusion protein. SEQ ID NO 186 is a nucleic acid sequence of the IGF1_mHSA_DAscFv fusion protein.

SEQ ID NO SEQ ID NOs: 187-190 are the nucleic acid sequences of a growth factor polypeptide corresponding to human FGF2 (SEQ ID NO:38).

SEQ ID NOs 191-94 are the nucleic acid sequences of a growth factor polypeptide corresponding to HGF alpha chain N-K1 domain (SEQ ID NO: 6, SEQ ID NO: 32).

SEQ ID NOs 195-197 are the nucleic acid sequences of a growth factor polypeptide corresponding to wild type human IGF-I (SEQ ID NO 3).

SEQ ID NO 198 is the nucleic acid sequence of a growth factor polypeptide corresponding to human NRG1 alpha, full sequence (SEQ ID NO 40).

SEQ ID NO 199 is the nucleic acid sequence of a growth factor polypeptide corresponding to human NRG1 alpha, EGF-like domain (SEQ ID NO 39).

SEQ ID NOs 200-202 are the nucleic acid sequences of a growth factor polypeptide corresponding to human NRG1 beta EGF like domain (SEQ ID NO 56).

SEQ ID NO 203 is the nucleic acid sequence of a growth factor polypeptide corresponding to a region of human periostin (SEQ ID NO 58).

SEQ ID NO 204 is the nucleic acid sequence of a growth factor polypeptide corresponding to human bone morphogenetic protein-2 (SEQ ID NO 59).

SEQ ID NO 205 is the nucleic acid sequence of a growth factor polypeptide corresponding to a single chain human bone morphogenetic protein-2 (SEQ ID NO 60).

SEQ ID NO 206 is the nucleic acid sequence of a growth factor polypeptide corresponding to a human VEGF alpha monomer (SEQ ID NO 36).

SEQ ID NO 207 is the nucleic acid sequence of a growth factor polypeptide corresponding to human VEGF alpha dimmer (SEQ ID NO 37).

SEQ ID NOs 208-209 are the nucleic acid sequences of a growth factor polypeptide corresponding to vascular endothelial growth factor B (SEQ ID NO 61).

SEQ ID NOs 210-211 are the nucleic acid sequences of a growth factor polypeptide corresponding to the human vascular endothelial growth factor B.

SEQ ID NOs 212-214 are the nucleic acid sequences of a half life modulator corresponding to human serum albumin (HSA) linker with C34S and N503Q substitutions (SEQ ID NO 10).

SEQ ID NO 215 is a nucleic acid sequence of a half life modulator corresponding to the domain III of a modified Human Serum Albumin (SEQ ID NO 67).

SEQ ID NO 216 is a nucleic acid sequence of a half life modulator corresponding to a modified AFP (SEQ ID NO 69).

SEQ ID NO 217 is a nucleic acid sequence of a half life modulator corresponding to the albumin-binding domain human antibody (SEQ ID NO 70).

SEQ ID NO 218 is a nucleic acid sequence of a half life modulator corresponding to monomeric variant form of Fc, named scFc (SEQ ID NO 71).

SEQ ID NO 219 is a nucleic acid sequence of a half life modulator corresponding to a modified Vitamin D Binding Protein, mVDBP (SEQ ID NO 66).

SEQ ID NOs 220-221 are nucleic acid sequences corresponding to anti-DNA scFv antibody (SEQ ID NO 73).

SEQ ID NO 222 is a nucleic acid sequence corresponding to the anti-DNA scFv SI-1 (SEQ ID NO 1).

SEQ ID NO 223 is a nucleic acid sequence corresponding to the B7scFv anti-myosin scFv antibody (SEQ ID NO 76).

SEQ ID NO 224 is a nucleic acid sequence corresponding to the anti-phosphatidylserine scFv PS4A7 (SEQ ID NO 30).

SEQ ID NOs 225-227 are nucleic acid sequences corresponding to human annexin V (SEQ ID NO 31).

SEQ ID NO 228 is a nucleic acid sequence corresponding to a variant of human annexin V (C317S, SEQ ID NO 81).

SEQ ID NOs 229-230 are nucleic acid sequences corresponding to a variant of human annexin V AnxVm3, SEQ ID NO 82).

SEQ ID NOs 231-232 are nucleic acid sequences corresponding to a non-internalizing variant of annexin V (AnxVm23, SEQ ID NO 83).

SEQ ID NOs 233-234 are nucleic acid sequences corresponding to a non-binding variant of annexin V (AnxVm1234, SEQ ID NO 84).

SEQ ID NO 235 is a nucleic acid sequence corresponding to synaptotagmin I (SEQ ID NO 72).

SEQ ID NOs 236-237 are nucleic acid sequences corresponding to non-binding scFv variant (DAscFv; SEQ ID No 75).

SEQ ID NOs 238 is a nucleic acid sequence corresponding to a leader polypeptide.

SEQ ID NO 239 is a nucleic acid sequence corresponding to alpha mating factor.

SEQ ID NO 240 is a nucleic acid sequence corresponding to app8 leader polypeptide.

SEQ ID NO 241 is a nucleic acid sequence corresponding to aga2 signal peptide.

SEQ ID NO 242 is a nucleic acid sequence corresponding to SUC2 signal peptide.

SEQ ID NO 243 is a nucleic acid sequence corresponding to a synthetic signal peptide.

SEQ ID NO: 244 is an amino acid sequence corresponding to the alpha-factor signal sequence. SEQ ID NO 245 is a nucleic acid sequence corresponding to the alpha-factor signal sequence.

SEQ ID NO 246 is an amino acid sequence of the DAscFv_mHSA_IGF1 fusion protein. SEQ ID NO 247 is a nucleic acid sequence corresponding to the DAscFv_mHSA_IGF1 fusion protein.

SEQ ID NO 248 is an amino acid sequence of the DAscFv_mHSA_HGF(NK1) fusion protein. SEQ ID NO 249 is a nucleic acid sequence corresponding to the DAscFv_mHSA_HGF(NK1) fusion protein.

SEQ ID NO 250 is an amino acid sequence of the AnxVm1234_mHSA fusion protein. SEQ ID NO 251 is a nucleic acid sequence corresponding to the AnxVm1234_mHSA fusion protein.

SEQ ID NO 252 is an amino acid sequence of the AnxV_mHSA fusion protein. SEQ ID NO 253 is a nucleic acid sequence corresponding to the AnxV_mHSA fusion protein.

SEQ ID NO 254 is an amino acid sequence of the NRG1b(EGF)_mHSA_AnxVm1234 fusion protein. SEQ ID NO 255 is a nucleic acid sequence corresponding to the NRG1b(EGF)_mHSA_AnxVm1234 fusion protein.

SEQ ID NO 256 is an amino acid sequence of the AnxVm23_mHSA fusion protein. SEQ ID NO 257 is a nucleic acid sequence corresponding to the AnxVm23_mHSA fusion protein.

SEQ ID NO 258 is an amino acid sequence of the AnxVm1234_mHSA_VEGFB(111) fusion protein. SEQ ID NO 259 is a nucleic acid sequence corresponding to the AnxVm1234_mHSA_VEGFB(111) fusion protein.

SEQ ID NO 260 is an amino acid sequence of the AnxVm1234_mHSA_VEGFB(167) fusion protein. SEQ ID NO 261 is a nucleic acid sequence corresponding to the AnxVm1234_mHSA_VEGFB(167) fusion protein.

SEQ ID NO 262 is an amino acid sequence of the AnxVm1234_mHSA_HGF(NK1) fusion protein. SEQ ID NO 263 is a nucleic acid sequence corresponding to the AnxVm1234_mHSA_HGF(NK1) fusion protein.

SEQ ID NO 264 is an amino acid sequence of the AnxVm1234_mHSA_FGF2 fusion protein. SEQ ID NO 265 is a nucleic acid sequence corresponding to the AnxVm1234_mHSA_FGF2 fusion protein.

SEQ ID NO 266 is an amino acid sequence of the mHSA_AnxV fusion protein. SEQ ID NO 267 is a nucleic acid sequence corresponding to the mHSA_AnxV fusion protein.

SEQ ID NO 268 is an amino acid sequence of the mHSA_AnxVm23 fusion protein. SEQ ID NO 269 is a nucleic acid sequence corresponding to the mHSA_AnxVm23 fusion protein.

SEQ ID NO 270 is an amino acid sequence of the mHSA_AnxVm1234 fusion protein. SEQ ID NO 271 is a nucleic acid sequence corresponding to the mHSA_AnxVm1234 fusion protein.

SEQ ID NO 272 is an amino acid sequence of the HGF(NK1)_mHSA_AnxVm1234 fusion protein. SEQ ID NO 273 is a nucleic acid sequence corresponding to the HGF(NK1)_mHSA_AnxVm1234 fusion protein.

SEQ ID NO 274 is an amino acid sequence of VEGFB (167)_mHSA_AnxVm1234 fusion protein. SEQ ID NO 275 is a nucleic acid sequence corresponding to the VEGFB(167)_mHSA_AnxVm1234 fusion protein.

SEQ ID NO 276 is an amino acid sequence of VEGFB(111)_mHSA_AnxVm1234 fusion protein. SEQ ID NO 277 is a nucleic acid sequence corresponding to the VEGFB(111)_mHSA_AnxVm1234 fusion protein.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIGS. 33A, 33B, 33C, 33D, 33E, and 33F represent different structures of certain bi-specific fusion proteins according to some embodiments.

DETAILED DESCRIPTION OF THE INVENTION

Figure 1:
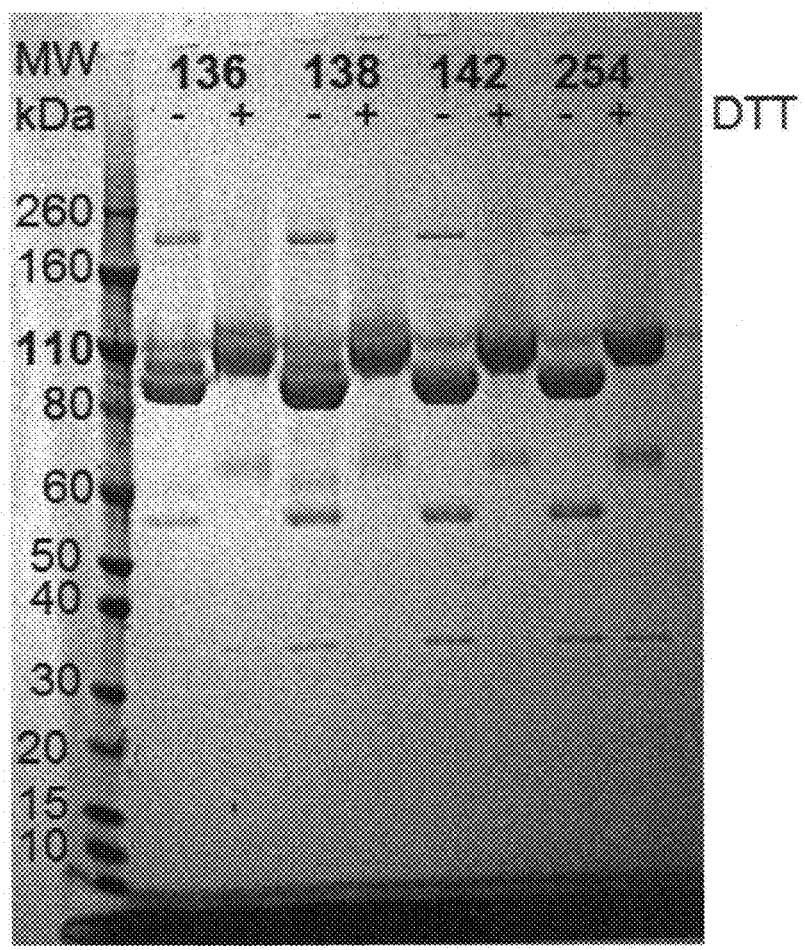
FIG. 1 is a SDS-PAGE of purified IGF1_mHSA_AnxV (136), IGF1_mHSA_AnxVm1234 (138), NRG1b(EGF)_mHSA_AnxV (142) and NRG1b(EGF)_mHSA_AnxVm1234 fusion proteins.

Aspects of the invention are directed to a bi-specific fusion protein that comprises two binding domains, a targeting domain having a binding specificity to a specific target molecule or target cell and an activator domain having a binding specificity to a receptor that modulates tissue regeneration. In some embodiments, the targeting domain serves to target the bi-specific fusion protein to a target cell or tissue while activator domain serves to activate a cell thereby to promote regeneration of the targeted tissue. As used herein a "bi-specific protein" refers to a fusion protein capable of specific binding to two or more specific molecules.

In some embodiments, the bi-specific protein comprises (1) a targeting domain having a binding specificity to a molecule associated with a damaged cell of a tissue, wherein the molecule is intracellular in a viable cell and exposed to the extracellular space in the damaged cell; and (2) an activator domain having a binding specificity to a growth factor receptor or a cytokine receptor of a cell in the tissue, wherein upon exposure of the activator domain to the growth factor receptor or cytokine receptor, the activator domain binds the growth factor receptor or cytokine receptor so as to modulate regeneration or survival of the tissue.

In some embodiments, the bi-specific fusion protein comprises (1) a targeting domain having a binding specificity to a molecule associated with a damaged cell of a tissue, wherein the molecule is intracellular in a viable cell and exposed to the extracellular space in the damaged cell; (2) an activator domain having a binding specificity to a molecule associated with the surface of a cell in the tissue, wherein upon exposure of the activator domain to membrane-associated molecule, the activator domain binds the membrane-associated molecule so as to modulate regeneration of the tissue and (3) a half life modulator wherein the half life modulator modulates the half life of the bi-specific fusion protein.

In some embodiments, the bi-specific proteins comprises: (1) a targeting polypeptide domain that binds to an ischemia-associated molecule; and (2) an activator domain, such as a growth factor polypeptide or a cytokine polypeptide so as to promote tissue regeneration or survival.

In some embodiments, the bi-specific fusion protein comprises (1) a targeting domain having a binding specificity to a target molecule associated with a tissue; (2) a binding domain (e.g. an activator domain) having a binding specificity to a molecule associated with the surface of a cell in the tissue, wherein upon exposure of the binding domain to the molecule, the binding domain binds the molecule so as to promote regeneration or survival of the tissue; and (3) a half life modulator wherein the half life modulator modulates the half life of the bi-specific fusion protein.

In certain embodiments, the bi-specific fusion protein a half life modulator (HLM). In some embodiments, the HLM is a polypeptide. The HLM can have two termini, an N-terminus and a C-terminus, and is joined at one terminus via a peptide bond to the targeting polypeptide domain and is joined at the other terminus via a peptide bond to the activator domain. In other embodiments, the half life modulator is joined at one terminus (N-terminus or C-terminus) to the activator domain or to the targeting domain. Accordingly, the half life modulator can be at the N-terminus or at the C-terminus of the bi-specific fusion protein. The half life modulator may be joined to the targeting domain or the activator domain via peptide bonds.

Other aspects of the invention relate to fusion proteins comprising (1) at least one targeting domain having a binding specificity to at least one target molecule associated with a tissue; (2) at least one binding domain (such as an activator domain) having a binding specificity to at least one molecule associated with the surface of a cell in the tissue, wherein upon exposure of the binding domain to the molecule, the binding domain binds the molecule so as to promote regeneration of the tissue; and (3) optionally a half life modulator wherein the half life modulator modulates the half life of the fusion protein. In some embodiments, the fusion protein comprises two or more targeting domains, each targeting domain having a binding affinity to a target molecule associated with a tissue. Each of the targeting domains may have a same binding specificity (e.g., a binding specificity for the same target molecule) or a different binding specificity (e.g., a binding specificity for a different target molecule). In some embodiments, the fusion protein comprises two or more activator domains. Each of the activator domains may have the same binding specificity (e.g., a binding specificity to the same receptor on the cell) or different binding specificity (e.g., a binding specificity for a different receptor on a cell).

One skilled in the art will appreciate that such bi-specific fusion proteins can find use in tissue regeneration. In some embodiments, bi-specific fusion proteins can be used in diseased cells, following tissue or organ injury or following an event in which the cells of a tissue may be damaged. In some embodiments, the bi-specific fusion proteins can activate cells that express one or more growth factor and/or cytokine (e.g., chemokine) and/or integrin. In other embodiments, the bi-specific fusion proteins find use, for example, in recruiting cells that express one or more growth factor and/or cytokine (e.g., chemokine) receptors and/or integrins (e.g., stem cells, progenitor cells or immune system cells) to tissue following for example, injury, or an event in which the cells of a tissue may be damaged or may become dysfunctional (e.g. beta cell dysfunction in diabetes). Yet, in vivo, the administration of such bi-specific fusion proteins may be used to facilitate repair or regeneration of damaged tissue or organ.

In some embodiments, the bi-specific proteins disclosed herein can find use in modulating tissue survival. For example, the bi-specific proteins can enhance or maintain the viability of a cell. In some embodiments, the bi-specific fusion proteins can activate the pro-survival or the cell survival pathway. In some embodiments, the bi-specific proteins can modulate apoptosis.

In some embodiments, bi-specific proteins can have (a) a targeting polypeptide domain wherein the targeting domain binds to a target molecule thereby targeting the bi-specific fusion protein to a first cell of a tissue and (b) an activator domain having a binding specificity to a receptor. Upon exposure of the activator domain to the receptor, the activator domain can activate the receptor of a second cell so as to promote cell recruitment, inhibition of apoptosis, induction of cell proliferation, activation of the pro-survival pathway, regeneration, survival of the tissue. One skilled in the art will appreciate that the bi-specific fusion protein can bind to a first cell population and act on the same cell population (e.g. in an autocrine manner) or on a different cell population (e.g. in a paracrine manner). In some embodiments, the targeting domain binds specifically to a target molecule associated with a damaged first cell population and the activator domain binds specifically to a receptor of a second cell population of viable cells. Yet in some embodiments, the targeting domain binds specifically to a tissue specific target molecule at the surface of a first cell population and the activator domain acts specifically to a second cell population. The first cell can be a viable cell, or an "at risk" cell. As used herein "at risk" cell refers to a viable cell that has not yet undergone apoptosis or is not damaged but is at risk to be damaged.

In some embodiments, the bi-specific protein has two different binding domains (such targeting domain and activator domain) which bind to different molecule on different cells in a tissue or organ. Yet in other embodiments, the bi-specific protein has two different binding domains which bind to different molecules on the same target cell in a tissue, the targeting domain being selected to bind specifically a target cell and the activator domain selected to promote tissue regeneration.

The term "polypeptide" is used herein to refer to a molecule that consists of multiple amino acid residues linked by peptide bonds. This term carries no implication as to the number of amino acid residues so linked.

The term "bi-specific," as used herein, refers to the ability of the fusion protein to interact with two different ligands: a target molecule (bound by the targeting polypeptide domain) and a receptor for the activator domain. The binding properties of the targeting polypeptide domain and the activator domain are discussed in more detail below.

As used herein the term "target molecule" refers to any molecule that is associated with a tissue (e.g. diseased or damaged tissue). A "target cell" is meant to be a cell to which a bi-specific protein or targeting domain thereof can specifically bind. Preferred target molecules are exposed or enriched on the exterior of a target cell. In some embodiments, the target molecule is associated with a damaged cell, the target molecule being intracellular in a viable or undamaged cell and being exposed to the extracellular space in a damaged cell. Such molecules include, for example, molecules that are exposed in cells that undergo necrosis (such as DNA) or apoptosis (e.g., phosphatidylserine), myosin (including the tissue type-specific subtypes thereof), ICAM-1 or P-selectin. Yet in other embodiments, the target molecule is a molecule that is present or enriched at the surface of a diseased or dysfunctional cell or tissue as compared to the level detected in a healthy or functional cell or tissue.

Cells are bounded by a plasma membrane (or cell membrane) comprising a lipid bilayer. The cell membrane may be considered to have a surface facing the cytosol (cytosolic side or interior of the cell) and a surface facing the exterior of the cell, or the extracellular space. Transbilayer movement of anionic phospholipids from the inner to the outer leaflet of the plasma membrane occurs during apoptosis. The anionic phospholipid-binding protein, such as annexin V, synaptotagmin I or lactadherin can be used to detect the presence of phosphatidylserine on the outer leaflet of the cell membrane. Phosphatidylserine is a phospholipid, that is usually restricted to the cytosolic side of the membrane in viable or undamaged cells, and that becomes exposed on the outer cell surface or to the extracellular space in apoptosis. Phosphatidylserine has been used as a marker in in vivo imaging studies (see Table 2).

In some embodiments, the target molecule is a "ischemia-associated molecule". An "ischemia-associated molecule" is any molecule that is detected at a level that is significantly higher (e.g., at least 2-fold higher) following ischemia or hypoxia. Any suitable binding assay may be used to identify ischemia-associated molecules, including those provided herein. The increased level of molecule that is detected may be the result of upregulation or decreased turnover, or may be due to increased accessibility (e.g., resulting from cell damage). In certain embodiments, the ischemia-associated molecule is detected in a cell of post-ischemic tissue at a significantly higher level (e.g., at least 2-fold higher) than in a cell of the same tissue that has not undergone an ischemic event (i.e., the molecule is specific to or enriched in the post-ischemic tissue). In further embodiments, the ischemia-associated molecule is associated with cell damage (i.e., the molecule is detected at a significantly higher level in cells that are damaged than in undamaged cells of the same type). Certain ischemia-associated molecules are enriched (2-fold or higher) in the heart after an ischemic event (or in a model system that is used to mimic ischemia in the heart). Such molecules include, for example, molecules that are exposed on myocytes or other cardiac cells that undergo necrosis (such as DNA) or apoptosis (e.g., phosphatidylserine) or molecules that are enriched in scarred heart tissue, such as collagen (collagen I, III), myosin (including the cell type-specific subtypes thereof), or other extracellular matrix proteins that are enriched in post ischemic hearts. Such molecules can be identified on the basis of enrichment following ischemia-reperfusion in vivo or in simulated ischemia-reperfusion in vitro, or following exposure to conditions such as hypoxia, decreased ATP, increased reactive oxygen species (ROS) or nitric oxide synthase (NOS) production, or serum starvation of cells cultured in vitro.

The Targeting Polypeptide Domain

Binding to the target molecule associated with a tissue (for example, the ischemia-associated molecule) is mediated by the targeting polypeptide domain. This domain may be any polypeptide sequence that serves this function. Preferably, binding of the targeting domain to the target molecule does not have a biological activity. As used herein, "biological activity" refers to a defined, known activity performed by exposure of a molecule to a domain of the fusion protein.

In some embodiments, the targeting domain is a non-antibody naturally occurring polypeptide having a binding affinity to the target molecule, fragment thereof or variant thereof. Yet in other embodiments, the targeting polypeptide domain comprises one or more antibody variable regions. One skilled in the art will appreciate that any targeting domain capable of binding directly or indirectly to the target molecule is contemplated.

In some embodiments, the targeting domain is annexin V (SEQ ID NO: 31), fragment thereof, or variant thereof (SEQ ID NOs: 81-83). Annexin V binds to phosphatidylserine (PS). In some embodiments, annexin V is modified to substitute cysteine 315 with serine or alanine to reduce dimer formation. In some embodiments, annexin V is modified to reduce internalization of Annexin V while maintaining phosphatidylserine binding affinity. In some embodiments, one or more residues of annexin V may be altered to modify binding to achieve a more favored on-rate of binding to the target molecule, or a more favored off-rate of binding to the target molecule. In some embodiments, variants of annexin V in which D144 was substituted to N, and/or E228 was substituted with A can be used (see Mira, 1997; Kenis, 2004; Kenis 2010 and Ungthum, 2010).

In other embodiments, the targeting domain is synaptotagmin I, fragment thereof, or variant thereof. Synaptotagmin I (SytI) has been shown to bind phosphatidylserine in a Ca(2+)-dependent manner with a binding affinity of about 5 to 40 nM. In some embodiments, one of the two C2 domains of synaptotagmin (e.g., C2B) can be used as the targeting domain. In some embodiments, the targeting domain is a C2 domain of Ca2+-dependent membrane-targeting proteins involved in signal transduction or membrane trafficking (e.g., protein kinase C, blood coagulation factor V and VIII). In some embodiments, the targeting domain has sequence recited in SEQ ID. NO: 72. Lactadherin, also known as milk fat globule-EGF 8, is a 45 kDa phosphatidylserine-binding glycoprotein secreted by macrophages. Lactadherin contains EGF-like domains at the amino terminus and two C-domains at the carboxy terminus. Accordingly, in some embodiments, the targeting domain comprises the C-domain of lactadherin, fragment thereof or variant thereof. In some embodiments, one or more residues of the C2 domain may be altered to modify binding to achieve a more favored on-rate of binding to the target molecule, or to achieve a more favored off-rate of binding to the target molecule. In some embodiments, the targeting domain has sequence recited in SEQ ID. NOs: 85 or 86. In some embodiments, the targeting polypeptide domain comprises a T cell immunoglobulin mucin 1 & 4 (TIM protein). In other embodiments, the targeting polypeptide domain comprises a 3G4 antibody or antibody domain capable of binding indirectly to phosphatidylserine through plasma 2-glycoprotein 1. Yet in other embodiments, the targeting polypeptide domain comprises an anti-phosphatidylserine antibody (e.g. PS4A7, SEQ ID NO. 30) or antibody domain capable of binding phosphatidylserine.

In some embodiments, the targeting polypeptide domain comprises a polypeptide that binds to the target molecule. Representative such polypeptides comprise or have the sequences provided herein as SEQ ID NOs: 31, 72, 81-83 or 85-86. Representative such polypeptides nucleic acid sequences comprise or have the sequences provided herein as SEQ ID NOs: 225-232 or 235.

Native polypeptide can be used as targeting domains. It will be apparent, however, that portions of such native sequences and polypeptides having altered sequences may also be used, provided that such polypeptides retain the ability to bind the target molecule with an appropriate binding affinity (Kd) as described in more details below.

As used herein, an "antibody" is a protein consisting of one or more polypeptides substantially encoded by immunoglobulin genes. A typical antibody is a tetramer that is composed of two identical pairs of polypeptide chains, each pair having one "light" (about 25 kD) and one "heavy" chain (about 50-70 kD). "$V_L$" and "$V_H$" refer to these light and heavy chains respectively. An "antibody variable region" is an N-terminal region of an antibody variable chain ($V_L$ or $V_H$) comprising amino acid residues that are primarily responsible for antigen recognition. Those of ordinary skill in the art are readily able to identify an antibody variable region and to determine the minimum size needed to confer antigen recognition. Typically, an antibody variable region comprises at least 70 amino acid residues, and more commonly at least 100 amino acid residues. A polypeptide that comprises an antibody variable region may (but need not) further comprise other light and/or heavy chain sequences, and may (but need not) further comprise sequences that are not antibody-derived. It will be apparent that the sequence of an antibody variable region may be naturally-occurring, or may be modified using standard techniques, provided that the function (antigen recognition) is retained. Certain polypeptides that comprise an antibody variable region are single chain antibodies (antibodies that exist as a single polypeptide chain), more preferably single chain Fv antibodies (scFv) in which a variable heavy chain region and a variable light chain region are joined together (directly or through a peptide linker) to form a continuous polypeptide. The scFv antibody may be chemically synthesized or may be expressed from a nucleic acid including $V_H$- and $V_L$-encoding sequences either joined directly or joined by a peptide-encoding linker.

"Binding" or "specific binding" are used interchangeably herein and indicates that a bi-specific protein exhibits substantial affinity for a specific molecule (e.g., targeting domain exhibits substantial affinity for a target molecule, or an activator domain exhibits substantial affinity for a molecule associated with the surface of a cell such as a receptor) or a cell or tissue bearing the molecule and is said to occur when the fusion protein (or the targeting polypeptide domain thereof or the activator domain thereof) has a substantial affinity for the specific molecule and is selective in that it does not exhibit significant cross-reactivity with other molecules. Preferred substantial binding includes binding with a dissociation constant ($K_d$) of $10^{-6}$, $10^{-7}$, $10^{-8}$, $10^{-9}$, $10^{10}$, $10^{-11}$, $10^{-12}$ M or better. For example, the $K_d$ of an antibody-antigen interaction indicates the concentration of antibody (expressed as molarity) at which 50% of antibody and antigen molecules are bound together at thermodynamic equilibrium. Thus, at a suitable fixed antigen concentration, 50% of a higher (i.e., stronger) affinity antibody will bind antigen molecules at a lower antibody concentration than would be required to achieve the same percent binding with a lower affinity antibody. $K_d$ is also the ratio of the kinetic on and off rates ($k_{on}$ and $k_{off}$); i.e., $K_d = k_{off}/k_{on}$. Thus, a lower $K_d$ value indicates a higher (stronger) affinity. As used herein, "better" affinities are stronger affinities, and are identified by dissociation constants of lower numeric value than their comparators, with a $K_d$ of $10^{-10}$ M being of lower numeric value and therefore representing a better affinity than a $K_d$ of $10^{-9}$M. Affinities better (i.e., with a lower $K_d$ value and therefore stronger) than $10^{-7}$M, preferably better than $10^{-8}$M, are generally preferred. Values intermediate to those set forth herein are also contemplated, and preferred binding affinity can be indicated as a range of dissociation constants, for example preferred binding affinities for antibodies disclosed herein are represented by $K_d$ values ranging from $10^{-6}$ to $10^{-12}$M (i.e., micromolar to picomolar), preferably $10^{-7}$ to $10^{-12}$M, more preferably $10^{-8}$ to $10^{-12}$ M or better. An antibody that "does not exhibit significant cross-reactivity" is one that will not appreciably bind to an off-target antigen. For example, in one embodiment, an antibody that specifically and selectively binds to cardiac myosin will exhibit at least a two, and preferably three, or four or more orders of magnitude better binding affinity (i.e., binding exhibiting a two, three, or four or more orders of magnitude lower $K_d$ value) for cardiac myosin than for myosin molecules other than cardiac myosin or for non-myosin proteins or peptides. Binding affinity and selectivity can be determined using any art-recognized methods for determining such characteristics, including, for example, using Scatchard analysis and/or competitive (competition) binding assays.

Binding may be assessed, and $K_d$ values determined, using any of a variety of techniques that are well known in the art. For example, binding to an ischemia-associated DNA molecule is commonly assessed by coating an appropriate solid support (e.g., beads, ELISA plate or BIACORE chip) with target DNA fragments. For a targeting polypeptide domain that binds to any sequence of DNA, DNA fragments (single or double-stranded) of 10 base pairs or larger are immobilized on the solid substrate. For a targeting polypeptide domain that binds to a specific sequence or DNA complex (e.g., DNA-histone complex) the appropriate corresponding target is immobilized. Prior to adding the ischemia-associated molecule, non-specific binding sites for protein are blocked with BSA, milk, or any other appropriate blocker. Uncoated wells or wells coated with a non-target molecule serve as specificity controls. Increasing concentrations of the bi-specific fusion protein (or targeting polypeptide domain) are incubated with target-coated substrate or control substrate. A fusion protein or domain that does not bind to the target is also tested as a specificity control. Target specific, dose-dependent binding of the bi-specific fusion protein (or targeting polypeptide domain) is then assessed by measuring the amount of bi-specific fusion protein (or targeting polypeptide domain) binding to target versus controls as a function of increasing dose using standard protocols corresponding to the solid support and binding technology being used. Representative such protocols include those described in Wassaf et al., *Anal. Biochem.* 351(2):241-53 (2006); Epub 2006 Feb. 10 (BIACORE); and Murray and Brown, *J. Immunol. Methods.* 127 (1):25-8 (1990) (ELISA). In addition, studies that vary the amount of immobilized target molecule or that include increasing levels of soluble target molecule as a competitor may also be performed to monitor binding and specificity.

The binding affinity and kinetic on and off rates for binding to the target molecule are measured using standard techniques and compared to other negative control molecules (e.g., fusion protein with irrelevant targeting polypeptide or fusion protein lacking a targeting polypeptide or fusion proteins with non-binding targeting polypeptide and positive control molecules (e.g., parental antibody that targets the target molecule, or other antibodies or antibody fragments that are known to bind to the target molecule). For example, the non-binding targeting polypeptide can be a non-binding annexin V variant (SEQ ID NO: 84, nucleic acid sequence SEQ ID NOs 233-234), a non-binding synaptotagmin variant (SEQ ID NO: 74) or a non-binding scFv (SEQ ID NO: 75; nucleic acid sequence SEQ ID NOs 236-237)

In certain embodiments, the $K_d$ is determined using a biosensor (e.g., by surface plasmon resonance (e.g., BIAcore) or resonant mirror analysis (IAsys)). Such determinations may be performed as described by Hefta et al., Measuring Affinity Using Biosensors, in "Antibody Engineering: A Practical Approach," McCafferty et al. (eds), pp. 99-116 (Oxford University Press, 1996), and references cited therein. Briefly, kinetic on and off rates ($k_{on}$ and $k_{off}$) are determined using a sensor chip to which the ischemia-associated molecule has been coupled. To evaluate association ($k_{on}$), solutions of different concentrations of bi-specific fusion protein (or targeting polypeptide domain) flow across the chip while binding is monitored using mass sensitive detection. Using the BIAcore system (GE Healthcare; Piscataway, N.J.), $k_{on}$ is the slope of the plot of dR/dt versus R, where R is the signal observed. Following binding, dissociation is observed by passing a buffer solution across the chip, and $k_{off}$ is determined in an analogous fashion. $K_d$ is then calculated using the equation:

$$K_d = k_{off}/k_{on}$$

In the context of the present invention, a bi-specific fusion protein binds to the target molecule if it binds with a $K_d$ of less than $10^{-8}$ M, preferably less than $10^{-7}$ M, $10^{-8}$ M, $10^{-9}$ M or $10^{-10}$ M. In addition, the binding of the bi-specific fusion protein to the target molecule in this assay is significantly higher (e.g., at least 2-, 10- or 100-fold higher) than binding of the bi-specific fusion protein to negative controls. Preferably, binding to the immobilized target can also be competed using excess soluble target.

As noted above, certain target molecules are specific to (or enriched in) damaged cells. Representative target molecules include but are not limited to phosphatidylserine, DNA, myosin, cardiac myosin, c-Met (HGF receptor), phosphatidylserine, P-selectin, and ICAM-1. Binding to damaged cells is conveniently demonstrated in vitro using cultured cells that are exposed to conditions that induce necrosis or apoptosis. For example, necrosis can be induced in cultured cardiomyocytes by simulated ischemia/reperfusion, and monitored using a LDH release assay, or trypan blue assay followed by subtraction of the number of cells undergoing apoptosis, essentially as described in Shan et al., *Am. J. Physiol. Cell. Physiol.* 294:833-841 (2008). This assay quantitates the total dead cells and the difference between the total and the number of apoptotic cells is attributed to necrosis, as discussed in more detail below. Conditions that induce apoptosis include exposure to $H_2O_2$, and apoptosis can be monitored using any of a variety of techniques known in the art including, for example, annexin V binding, cleavage of target peptide sequences by known caspases that are activated by apoptosis, or DNA laddering (measured by TUNEL assay, essentially as described in Kuramochi, *J. Biol. Chem.* 279(49): 51141-47 (2004)). Binding to the cells undergoing necrosis or apoptosis may be assessed by adding fluorescently labeled bi-specific fusion protein (or targeting polypeptide domain) or appropriate control proteins to cells following the induction of apoptosis or necrosis. After incubation of the proteins with the cells for times ranging from a few minutes to one day, the cells are washed and then the cell-bound fluorescence is measured using immunofluorescence, flow cytometry, or similar techniques. Alternatively, other methods of detecting the bound bi-specific fusion protein (or targeting polypeptide domain) may be used, including radiolabeling or using enzymes conjugated to the bi-specific fusion protein (or targeting polypeptide domain) or to antibodies that bind to the fusion protein (or targeting polypeptide domain), which is common practice in ELISA protocols. The bi-specific fusion protein (or targeting polypeptide domain) binds to target cells if significantly higher (e.g., 2-fold higher) binding to cells following ischemia (e.g., cells undergoing necrosis or apoptosis) is detected, as compared to cells that have not experienced injury (e.g., cells not undergoing apoptosis or necrosis).

In vivo targeting may be demonstrated by inducing, for example, ischemia in an animal model and comparing the level of administered bi-specific fusion protein (or targeting polypeptide domain) in a target tissue before and after ischemia. In vivo targeting to damaged cells may be demonstrated by inducing tissue damage in an animal model, administering the bi-specific fusion protein (or targeting polypeptide domain), and comparing the level of bi-specific fusion protein (or targeting polypeptide domain) in damaged versus undamaged cells. In one embodiment, the bi-specific fusion proteins are designed to target areas of tissue damage following ischemia-reperfusion injury. In such a case, demonstration of in vivo targeting may be accomplished by inducing tissue damage, preferably by a method that causes ischemia followed by re-establishment of blood supply. Numerous methods are available to do this in different tissues. For example, blood flow to the hindlimb of the mouse can be transiently blocked with a simple tourniquet. Alternatively, temporary clamp on the artery leading into the kidney can be employed. Ischemia-reperfusion injury can be induced in the heart through temporary blockage of the coronary artery as demonstrated in mice, rats, dogs, and pigs. Representative methods for inducing tissue damage in an animal model are summarized in Table 1.

TABLE 1

Representative Methods used to Induce Ischemia-Reperfusion Damage

| Organ or tissue | Methods used to induce damage | Reference |
|---|---|---|
| Heart | Mouse: left anterior descending artery (LAD) clamped for up to 30 to minutes followed by reperfusion Rat: coronary artery ligation | Dumont et al., *Circulation* 102(13): 1564-8 (2000) Davis, *Proc. Natl. Acad. Sci. USA* 23: 103(21): 8155-60 (2006) |
| Kidney | Mouse: Renal artery clamped with pediatric suture for 1-6 hrs | Chen et al., *FASEB J.* 4(12): 3033-39 (1990) |
| Liver | Dog: The hepatic pedicle and hepatic artery (close to the celiac artery) were cross-clamped with vascular clamps. | Miranda et al., *Braz. J. Med. Biol. Res.* 40(6): 857-65 (2007) Kobayashi et al., *World J. Gastroenterol.* 13(25): 3487-92 (2007) |
| Hindlimb | Pig: Details in reference | Zbinden et al., *Am. J. Physiol. Heart Circ. Physiol.* 292: H1891-H1897 (2007) |

Animal models for ischemia-reperfusion injury are further detailed in the following references:

Greenberg et al., Chapter 7. Mouse models of ischemic angiogenesis and ischemia-reperfusion injury. *Methods Enzymol.* 444:159-74 (2008).

Chimenti et al., Myocardial infarction: animal models. *Methods Mol. Med.* 98:217-26 (2004).

Black S C, In vivo models of myocardial ischemia and reperfusion injury: application to drug discovery and evaluation. *J. Pharmacol. Toxicol. Methods* 43(2):153-67 (2000).

The specificity of targeting can be established by comparing the bi-specific fusion protein (or targeting polypeptide domain) deposition in the clamped versus unclamped kidney as shown in Chen et al., *FASEB J.* 4(12): 3033-39 (1990), or in the treated versus untreated hindlimb as shown in Zbinden et al., *Am. J. Physiol. Heart Circ. Physiol.* 292: H1891-H1897 (2007), using radiolabeled bi-specific fusion protein (or targeting polypeptide domain). Alternatively, bi-specific fusion protein (or targeting polypeptide domain) can be detected in homogenized tissue using ELISA, or can be imaged in real time using bi-specific fusion protein (or targeting polypeptide domain) labeled with the appropriate metal for imaging (e.g., Tc99, Y or Gd). Specific deposition in the damaged area of the heart can be measured as described in Dumont et al., *Circulation* 102(13):1564-8 (2000). Representative methods for demonstrating targeting of proteins to damaged tissue are shown in Table 2.

TABLE 2

Demonstration of Targeting to Damaged Tissue

| Damaged organ or tissue targeted | Methods used to demonstrate targeted delivery | Reference |
|---|---|---|
| Heart | Humans: Tc99 labeling of annexin V followed by imaging in humans using SPECT in patients with myocardial infarction followed by reperfusion attempts via angioplasty or thrombolysis | Hofstra et al., *The Lancet* 356 (9225): 209-12 (2000) |
| Heart | Mouse: Fluorescent labeling of annexin V in murine model of ischemia reperfusion with distribution in the myocardium detected histologically | Dumont et al., *Circulation* 102(13): 1564-8 (2000) |
| Heart | Humans: Tc99 labeling of annexin V followed by imaging in humans using SPECT in patients undergoing cardiac transplant rejection | Hofstra et al., *The Lancet* 356 (9225): 209-12 (2000) |
| Heart | Mouse: Fluorescently-labeled growth factor imaged in heart tissue using confocal microscopy | Urbanek, *Proc. Natl. Acad. Sci. USA* 102 (24): 8692-97 (2005) |
| Damaged kidney targeted using radiolabeled antibody to DNA | Radiographs of clamped versus unclamped kidney Microautoradiographs to show localization to specific cellular structures in the kidney Imaging of whole mouse using I131-labeled antibody to DNA (versus labeled control) Biodistribution of I125-labeled antibody to show deposition in non-target tissues | Chen et al., *FASEB J.* 4(12): 3033-9 (1990) |

As noted above, certain targeting polypeptide domains comprise an antibody that binds to the target molecule (e.g., DNA, myosin, cardiac myosin, c-Met, P-selectin, ICAM-1). In some embodiments, the targeting domain is an anti-myosin antibody (e.g. R11D-10 against human cardiac myosin, 2G4-sD7 against cardiac myosin heavy chain, 1B2 and 5C2 against human cardiac myosin heavy chain, 2F4 against human cardiac myosin, monoclonal antibodies against myosin, B7 antibody, B7 scFv, or other antibodies known in the art). In some embodiments, the certain targeting polypeptide domains comprise an scFv antibody that binds to the target molecule. For example, the targeting domain can be an anti-DNA S1-1 scFv (aDNAS11, SEQ ID NOs: 1, or 73) an anti-DNA SI-22 scFv (aDNAS122, SEQ ID NO: 2). Representative such antibodies and scFv antibodies comprise or have the sequences provided herein as SEQ ID NOs: 1, 2, 30, 73 and 76-80. In some embodiments, representative such antibodies and scFv antibodies nucleic acid sequences comprise or have the sequences provided herein as SEQ ID NOs 220-224.

It will be apparent that functionally related antibodies may also, or alternatively, be used as a targeting polypeptide domain. Antibodies interact with target antigens predominantly through amino acid residues that are located in the six heavy and light chain complementarity determining regions (CDRs). For this reason, the amino acid sequences within CDRs are more diverse between individual antibodies than sequences outside of CDRs. Because CDR sequences are responsible for most antibody-antigen interactions, it is possible to generate modified antibodies that mimic the properties of an original antibody by combining CDR sequences from one antibody with framework sequences from a different antibody. Such framework sequences can be obtained from public DNA databases that include germline antibody gene sequences.

Thus, one or more CDRs of a targeting polypeptide domain sequence provided herein can be used to create functionally related antibodies that retain the binding characteristics of the original targeting polypeptide domain. In one embodiment, one or more CDR regions selected from SEQ ID NOs: 1, 2, 30, 73 and 76-80 is combined recombinantly with known human framework regions and CDRs to create additional, recombinantly engineered, targeting polypeptide domains. The heavy and light chain variable framework regions can be derived from the same or different antibody sequences. CDR regions are readily identified using alignments with known sequences in databases such as Vbase and IMGT. The resulting targeting polypeptide domains share one or more CDRs with the targeting polypeptide domains of SEQ ID NOs: 1, 2, 30, 73 and 76-80. In certain embodiments, the targeting polypeptide domain comprises at least one CDR of a sequence as recited in SEQ ID NO: 1, 2, 30, 73 and 76-80.

It is well known in the art that antibody heavy and light chain CDR3 domains play a particularly important role in the binding specificity/affinity of an antibody for an antigen. Accordingly, in certain embodiments, antibodies are generated that include the heavy and/or light chain CDR3s of the particular antibodies described herein. The antibodies can further include the heavy and/or light chain CDR1 and/or CDR2s of the antibodies disclosed herein.

The CDR 1, 2, and/or 3 regions of the engineered antibodies described above can comprise the exact amino acid sequence(s) as those disclosed herein. However, the ordinarily skilled artisan will appreciate that some deviation from the exact CDR sequences may be possible, particularly for CDR1 and CDR2 sequences, which can tolerate more variation than CDR3 sequences without altering epitope specificity (such deviations are, e.g., conservative amino acid substitutions). Accordingly, in another embodiment, the engineered antibody may be composed of one or more CDR1s and CDR2s that are, for example, 80%, 90%, 95%, 98%, 99% or 99.5% identical to the corresponding CDRs of an antibody named herein.

In another embodiment, one or more residues of a CDR may be altered to modify binding to achieve a more favored on-rate of binding, or a more favored off-rate of binding. Using this strategy, an antibody having ultra high binding affinity (e.g., $K_d=10^{-10}$ or less) can be achieved. Affinity maturation techniques, well known in the art, can be used to alter the CDR region(s) followed by screening of the resultant binding molecules for the desired change in binding. Accordingly, as CDR(s) are altered, changes in binding affinity as well as immunogenicity can be monitored and scored such that an antibody optimized for the best combined binding and low immunogenicity are achieved.

Modifications can also be made within one or more of the framework or joining regions (i.e., non-CDR residues) of the heavy and/or the light chain variable regions of an antibody, so long as antigen binding affinity subsequent to these modifications is not substantially diminished.

The Activator Domain

The activator domain is any polypeptide that detectably modulates the activity of a cellular network or recruit cells from one location to another. In some embodiments, the activator domain is capable of activating signal transduction pathways by binding to a receptor at the surface a cell. In some embodiments, certain activator domains are growth factor polypeptides, cytokine polypeptides (e.g., a chemokine polypeptide), or any agonist of the receptor or integrin-binding ligands. It will be apparent that such modulation may be an increase or a decrease in the activity of the cellular network such as induction of proliferation of cells, induction of cell growth, promotion of cell survival and/or inhibition of apoptosis. In some embodiments, the activator domain can recruit other factors or cells (e.g. stem cells).

A growth factor polypeptide detectably modulates activation of a growth factor receptor (such as HGF or IGF receptor). Certain such polypeptides are wild-type hepatocyte growth factor (HGF) or HGF alpha chain (e.g., GENBANK accession number P14210), or derivatives thereof that retain at least 10% of wild-type biological activity, as determined by measuring activation of the corresponding growth factor receptor in appropriate target cells. Activation may be assessed, for example, by measuring phosphorylation of receptor kinase or downstream proteins, such as AKT, essentially as described by Nishi et al., *Proc. Natl. Acad. Sci. USA* 95:7018-7023 (1998). MTT and CTG assays known in the art may also be used.

In some embodiments, the activator domain is a growth factor. In some embodiments, the activator domain comprises the foregoing or a variant of the protein. Representative activator domains include but are not limited to fibroblast growth factor (FGF), fibroblast growth factor 1 (FGF1), fibroblast growth factor 2 (FGF2, also known as basic fibroblast growth factor (bFGF)), fibroblast growth factor 2, 146aa (FGF2-146aa), fibroblast growth factor 2, 157aa (FGF2-157aa), fibroblast growth factor 4 (FGF4), fibroblast growth factor 7 (FGF7), epidermal-growth factor (EGF), insulin-like growth factor (IGF), insulin-like growth factor 1 (IGF1), insulin-like growth factor 2 (IGF2), hepatocyte growth factor (HGF), hepatocyte growth factor-NK1 domains (HGF-NK1), hepatocyte growth factor-K1 domain (HGF-K1), hepatocyte growth factor-NK2 domains (HGF-NK2), hepatocyte growth factor-K2 domain (HGF-K2), neuregulin (NRG, also known as heregulin (HRG)), neuregulin-1beta extracellular domain (NRG1beta-ECD), neuregulin-1beta EGF-like domain (NRG1beta-EGF), thymosin, thymosin beta4 (Tbeta4), granulocyte colony-stimulating factor (G-CSF), stem cell factor (SCF, also known as mast cell growth factor (MGF)), periostin, vascular endothelial growth factor (VEGF, also known as vascular endothelial growth factor-A (VEGF-A)), vascular endothelial growth factor-A-121 (VEGF-A-121), vascular endothelial growth factor-A-165 (VEGF-A-165), vascular endothelial growth factor-B (VEGF-B), vascular endothelial growth factor-B-167 (VEGF-B-167), vascular endothelial growth factor-C(VEGF-C), stromal cell-derived factor (SDF), stromal cell-derived factor-1 (SDF-1), stromal cell-derived factor-1 alpha (SDF-1alpha), platelet-derived growth factor (PDGF), platelet-derived growth factor-AA (PDGF-AA), platelet-derived growth factor-AB (PDGF-AB), platelet-derived growth factor-BB (PDGF-BB), tetracarcinoma-derived growth factor (TDGF), teratocarcinoma-derived growth factor 1 (TDGF1), nerve growth factor (NGF), beta-nerve growth factor (beta-NGF), brain-derived neurotrophic factor (BDNF), neurotrophin-3 (NT-3), thrombopoietin (TPO), transforming growth factor-beta1 (TGF-beta1), transforming growth factor-beta2 (TGF-beta2), bone morphogenic protein (BMP), bone morphogenetic protein-2 (BMP2), single-chain BMP-2 (scBMP2), bone morphogenic protein 3 (BMP3), bone morphogenic protein 4 (BMP4), activin A, betacellulin, beta-catenin, dickkopf homolog 1 (DKK1), erythropoietin (EPO), growth hormone (GH), heparin-binding EGF-like growth factor (HBEGF), insulin, interleukin (IL), interleukin 6 (IL-6), interleukin 10 (IL-10), interleukin 33 (IL-33), leukemia inhibitory factor (LIF), monocyte chemotactic protein 1 (MCP1, also known as CCL2), pleiotrophin (PTN), tumor necrosis factor-alpha (TNF-alpha), Wnt, Wnt1, Wnt2, Wnt3a, Wnt7a, Wnt8a, Wnt11, or antibody having a specificity for the activator receptor, variant thereof, isoforms thereof, fragment thereof, and combinations thereof. In some embodiments, the activator domain is designed to comprise a single chain of a growth factor or growth factor domain. For example, the activator domain can be designed to comprise two or more copies of a growth factor domain (e.g. BMP-2) linked together via a linker (e.g., GGGGSGGGGSGGGGS (SEQ ID NO: 103).

Representative growth factor polypeptides have a sequence as recited in SEQ ID NO: 3-9 32-40, or 50-64, herein. Representative growth factor can be encoded by the nucleic acid sequences as recited in SEQ ID NOs: 187-211, herein.

As discussed above for CDRs of some of the targeting polypeptide domains, activator domains that share one or more domains, modules, or amino acid sequences with the activator domains or variations of SEQ ID NOs: 3-9, 32-40, or 50-64, are also contemplated. Such domains, modules, or amino acid sequences may be identified and such activator domains may be constructed using well known techniques. Thus, in certain embodiments, the activator domain comprises at least one domain, module, or amino acid sequence or variation of a sequence as recited in SEQ ID NO: 3-9, 32-40, or 50-64. Similarly, a cytokine polypeptide modulates activation of the corresponding cytokine receptor, as determined in the same fashion.

In certain embodiments, the activator domain is a growth factor polypeptide, which binds a growth factor receptor on a cell surface. Representative such growth factor receptors are receptors for epidermal growth factor (EGF), Neregulin/Heregulin (NRG/HRG), fibroblast growth factor (FGF), insulin-like growth factor (e.g., IGF-I), platelet-derived growth factor (PDGF), vascular endothelial growth factor (VEGF) and isoforms thereof (e.g., VEGF-A or VEGF-C), teratocarcinoma-derived growth factor 1 (TDGF1), transforming growth factor alpha (TGF-$\alpha$), transforming growth factor beta (TGF-$\beta$) and isoforms thereof e.g., TGF-$\beta$1 or TGF-$\beta$2, thrombopoietin (THPO) or periostin. Other such receptors include mast/stem cell growth factor receptor (SCFR), hepatocyte growth factor receptor (HGF receptor, i.e., c-Met), ErbB-2, ErbB-3, ErbB-4, high affinity nerve growth factor receptor, BDNF/NT-3 growth factors receptor, NT-3 growth factor receptor, or vascular endothelial growth factor receptor 1 (VEGFR-I).

Representative cytokine receptors include, for example, FL cytokine receptor, receptor for cytokine receptor common gamma chain, interleukin-10 receptor alpha chain, interleukin-10 receptor beta chain, interleukin-12 receptor beta-1 chain, interleukin-12 receptor beta-2 chain, interleukin-13 receptor alpha-1 chain, interleukin-13 receptor alpha-2 chain, interleukin-17 receptor; interleukin-17B receptor, interleukin 21 receptor precursor, interleukin-1 receptor type I, interleukin-1 receptor type II, interleukin-2 receptor alpha chain, interleukin-2 receptor beta chain, interleukin-3 receptor alpha chain, interleukin-4 receptor alpha chain, interleukin-5 receptor alpha chain, interleukin-6 receptor alpha chain, interleukin-6 receptor beta chain, interleukin-7 receptor alpha chain, high affinity interleukin-8 receptor A, high affinity interleukin-8 receptor B, interleukin-9 receptor, interleukin-18 receptor 1, interleukin-1 receptor-like 1 precursor, interleukin-1 receptor-like 2, toll-like receptor 1, toll-like receptor 2, toll-like receptor 5, CX3C chemokine receptor 1, C-X-C chemokine receptor type 3, C-X-C chemokine receptor type 4, C-X-C chemokine receptor type 5, C-X-C chemokine receptor type 6, C-C chemokine receptor type 1, C-C chemokine receptor type 2, C-C chemokine receptor type 3, C-C chemokine receptor type 4, C-C chemokine receptor type 6, C-C chemokine receptor type 7 precursor, C-C chemokine receptor type 8, C-C chemokine receptor type 9, C-C chemokine receptor type 10, C-C chemokine receptor type 11, chemokine receptor-like 2, and chemokine XC receptor. Still other activator domains are receptors for solute carrier organic anion transporter family, member 1A2 (SLCO1A2), sphingosine kinase 1 (SPHK1), secreted phosphoprotein 1 (SPP1), also called osteopontin (OPN), tumor protein 53 (TP53), troponin T type 1 (TNNT1), TSPY-like protein 2 (TSPYL2), visfatin, WAP four-disulfide core domain 1 (WFDC1), thymosin beta 4, wingless-type MMTV integration site family, member 11 (WNT11). Representative activator domains include, for example, resistin, stromal cell-derived factor-1 (SDF-1), signal-induced proliferation-associated gene 1 (SIPA1), and any of the other ligands listed above, as well as portions and derivatives of the foregoing that substantially retain the ability to bind to cognate receptors.

Integrins are receptors that mediate attachment of a cell to other cells or tissue surrounding it. Integrins bind cell surface and extracellular matrix components such as fibronectin, vitronectin, collagen and laminin. Representative integrins include for example, $\alpha_1\beta_1$, $\alpha_2\beta_1$, $\alpha_4\beta_1$, $\alpha_5\beta_1$, $\alpha_6\beta_1$ $\alpha_L\beta_2$, $\alpha_M\beta_2$, $\alpha_{IIb}\beta_3$, $\alpha_V\beta_3$, $\alpha_V\beta_5$, $\beta_V\beta_6$, $\alpha_6\beta_4$.

As an initial test, binding of a bi-specific fusion protein (or activator domain thereof) to the appropriate receptor may be assessed using techniques known in the art. In one representative assay, binding is demonstrated by coating an appropriate solid support with the recombinant ectodomain of the appropriate receptor. An ectodomain from a receptor not recognized by the activator domain of the bi-specific fusion protein is used as a specificity control. A support substrate that does not have any immobilized receptor is also used as a control. Similar to the methods described above for binding to the ischemia-associated molecule, specific, dose-dependent binding to receptor is demonstrated using standard protocols corresponding to the solid support and binding technology being used. In addition, studies that vary the amount of receptor or that include increasing levels of soluble target molecule as a competitor are also performed to monitor binding and specificity. Alternatively, the bi-specific fusion protein is immobilized to a support and the binding of the soluble ectodomain of the corresponding receptor(s) is used to demonstrate dose-dependent, specific binding.

The binding affinity and kinetic on and off rates for binding of the bi-specific fusion protein to the receptor(s) are also measured using standard techniques and compared to other negative control molecules (fusion protein with irrelevant control activator domain, fusion protein lacking an activator domain) and positive control molecules (recombinant wild-type receptor ligand, such as a growth factor or cytokine). The equilibrium and kinetic binding parameters of the bi-specific fusion protein are also compared to the same parameters measured for the un-fused wild-type ligand to determine whether fusion of the ligand to other molecules affects the normal binding of the ligand to its corresponding receptor. Such information may be used to determine the effective dose of the bi-specific fusion protein.

A bi-specific fusion protein binds to immobilized growth factor receptor or cytokine receptor with a significantly higher affinity (e.g., at least 100-fold) than that observed for negative controls. In addition, binding to the immobilized receptor can be competed using excess soluble polypeptide, soluble receptor, or antibodies that bind to polypeptide or receptor and block their interaction. Preferably, the bi-specific fusion protein binds to the growth factor or cytokine receptor with an affinity within 1000-fold of the native ligand binding to its receptor.

A bi-specific fusion protein (and its activator domain) further has the capacity to mediate cognate receptor activation. Such activity may be assessed, for example, using a cellular model of ischemia reperfusion, which uses cultured cardiomyocytes such as neonatal rat ventricular myocytes (NRVM) or cell lines. Simulated ischemia (SI) is generally initiated by metabolic inhibitors (deoxyglucose and dithionite) and metabolites (high potassium, lactate, low pH) or by hypoxia in an anaerobic chamber. Reperfusion is simulated by resuspension in an oxygenated buffer. An in vitro adult cardiomyocyte pellet model of ischemia has been developed that provides the two primary components of ischemia—hypoxia and metabolite accumulation—in the absence of any exogenous metabolic inhibitors or metabolites. Table 3 shows representative methods for demonstrating the ability of a bi-specific fusion protein to prevent damage of cardiomyocytes, promote growth, motility or differentiation of cardiac stem cells and/or promote repair of damaged tissue.

TABLE 3

Activity Assessment Methods

| Aspect | Assay | Reference |
|---|---|---|
| Localization and retention kinetics of activator domain | Detection of activator domain in cell lysate by ELISA<br>Detection of activator domain in cells by immunofluorescence (flow cytometry or microscopic) | Davis, *Proc Natl Acad Sci USA* 103(21): 8155-60 (2006)<br>Urbanek, *Proc. Natl. Acad. Sci. USA* 102 (24): 8692-97 (2005) |
| Signaling by activator domain | Detection of phospho-akt or phospho-ERK in cells by flow cytometry, immunofluorescence, ELISA, phospho-labeling, or Western | Davis, *Proc Natl Acad Sci USA* 103(21): 8155-60 (2006)<br>Urbanek, *Proc. Natl. Acad. Sci. USA* 102 (24): 8692-97 (2005) |
| Protection of cells against apoptosis following hypoxia or other cell stressor | AnnexinV binding by immunofluorescence or flow cytometry<br>Detection of caspase activity<br>TUNEL-assay (reduced number of TUNEL-positive cells)<br>DNA laddering<br>Cell viability<br>Enhancement of cardiomyocyte viability following exposure to $H_2O_2$. Number of rod-shaped cells<br>pPCR assessment of gene expression | |
| Protection of cells against necrosis | Reduced necrotic area by H&E staining | |
| Reduction in scar formation | Reduction in number of fibroblastic cells in infarct area<br>Reduction collagen deposition<br>Reduction in other matrix proteins associated with scar formation | |
| Migration of CSC into the infarct area | Time dependent increase in c-kit+, sca-1+, MDR1+ cell numbers and numbers undergoing transition to small myocytes | Urbanek, *Proc. Natl. Acad. Sci. USA* 102 (24): 8692-97 (2005) |
| Myocyte mechanics and cell fusion: | Frequency of distribution of myocyte sizes<br>Peak shortening<br>Velocity of shortening and relengthening<br>Assessment of cell fusion (number of X chromosomes) | Urbanek, *Proc. Natl. Acad. Sci. USA* 102 (24): 8692-97 (2005) |
| Cardiac functional assessment | Comparison of MI-treated versus MI-untreated animals<br>LVEDP<br>LVDP<br>+dp/dT<br>LV Weight<br>Chamber Volume<br>Diastolic Wall Stress<br>Survival | Urbanek, *Proc. Natl. Acad. Sci. USA* 102 (24): 8692-97 (2005) |
| Myocardial regeneration | Composition of regenerated myocardium<br>Assessment of BrdU+ cells in infarct area in treated versus untreated animals<br>Myosin+ cells in the infarct area in treated versus untreated animals | Urbanek, *Proc. Natl. Acad. Sci. USA* 102 (24): 8692-97 (2005) |
| Cardiac structural | Infarct size<br>Fibrosis<br>Cardiomyocyte hypertrophy | Urbanek, *Proc. Natl. Acad. Sci. USA* 102 (24): 8692-97 (2005) |

Native growth factors and cytokines can be used as activator domains. It will be apparent, however, that portions of such native sequences and polypeptides having altered sequences may also be used, provided that such polypeptides retain the ability to activate the cognate receptor (e.g., using one of the assays discussed below), such polypeptides detectably activate the receptor, and preferably activate the receptor to a degree that is at least 1% (preferably at least 10%) of that observed for the native ligand. Certain activator domains that bind to growth factor receptors are provided herein in SEQ ID NOs: 3-9, 32-40, and 50-64. Activity of fusion proteins comprising such sequences is well known in the art (e.g., Hashino et al., *J. Biochem.* 119(4):604-609 (1996); Nishi et al., *Proc. Natl. Acad. Sci. USA* 95:7018-23 (1998)).

An activator domain for a particular application may be selected based on the desired therapeutic outcome. For example, an activator domain that comprises FGF2, VEGF alpha, or a portion or derivative thereof, that substantially retains the ability to bind to cognate receptor, may generally be used to increase angiogenesis. To increase survival and for stem cell differentiation (regenerative) purposes, activator domains that comprise IGF, HGF or NRG1 (or a portion or derivative thereof) may be used.

In some cases, it may be desirable to assess the activity of both the activator domain and the targeting polypeptide simultaneously. An ELISA may be conveniently used for this purpose.

The substrate of the targeting polypeptide (e.g., DNA) is adsorbed to the ELISA plate, which is then blocked with appropriate BSA containing buffers. The bi-specific fusion protein is then added, followed by addition of recombinant substrate for the activator domain (e.g., if the activator is a growth factor, then the substrate is recombinant cognate receptor or receptor fragment (ectodomain)). This substrate is either fluorescently labeled for detection or detected using a labeled antibody to a region of the receptor that does not significantly affect ligand binding.

The in vivo activity of the bi-specific fusion protein is generally assessed by detecting signaling changes in molecules that are regulated by the activator domain of the bi-specific fusion protein. This typically involves changes in cell surface receptor phosphorylation status or downstream mediators such as phospho-AKT or phospho-ERK as detected by flow cytometry, immunofluorescence, ELISA, phospo-labeling, or Western analysis of treated tissues. Other functional assessments include tests for the number of viable cells by staining and morphological identification, level of apoptosis by annexin V binding (via immunofluorescence) or flow cytometry, detection of caspase activity, TUNEL-assay (reduced number of TUNEL-positive cells) or DNA laddering. In each case, a bi-specific fusion protein functions in vivo if it induces a significant (e.g., at least 2-fold) change in the level, functional activity, or phosphorylation of the regulated molecule detected by the assay. The repair of damaged tissue in a patient can be assessed using any clinically relevant standard. For example, repair of infarcted tissue can be measured by quantitation of cell number, such as the number of myocytes, fibroblast, or amount of scarring, or with functional assays for output or structural aspects of heart function including, LVEDP, LVDP, +dp/dT, LV Weight, Chamber Volume, and Diastolic Wall Stress. Methods for such assessments are well known and amply described in the literature. In general, a bi-specific fusion protein is said to repair damaged tissue if it results in a significant (e.g., at least 2-fold) change in any such clinical assessment.

Half Life Modulator

One skilled in the art would appreciate that bi-specific proteins used in therapeutic applications may not exhibit optimal serum half lives due to their relatively low molecular weight. In some therapeutic applications, it may therefore be desirable to modulate the half life of the bi-specific proteins. In some embodiments, to achieve accumulation of the bi-specific protein to the diseased injured or damaged area of an organ, the bi-specific protein is conjugated with a half-life modulator. Such half-life modulators can increase the in vivo half life of the fusion proteins. For example, the half life of the bi-specific proteins comprising the half life modulator is about 1 hour, 2 hour, 3 hours, 4 hours, 5 hours, 6 hours or greater. In some embodiments, the half life of the bi-specific proteins comprising the half life modulator is about 24 hours, or greater. In some embodiments, the half life of the bi-specific proteins comprising the half life modulator is about a week or greater.

The targeting polypeptide domain and activator domain may be directly joined via a peptide bond. In some embodiments, they may be joined via a half-life modulator. In preferred embodiments, the half-life modulator is a polypeptide. Accordingly, the half-life modulator can have two termini, an N-terminus and a C-terminus. In some embodiments, the half-life modulator is joined at one terminus via a peptide bond to the targeting polypeptide domain and is joined at the other terminus via a peptide bond to the activator domain. In certain embodiments, the linker is joined at the N-terminus to the C-terminus of the targeting polypeptide domain and at the C-terminus to the N-terminus of the activator domain. In other embodiments, the linker is joined at the C-terminus to the targeting polypeptide domain and at the N-terminus to the activator domain. Yet, in other embodiments, the half-life modulator is joined at one of the termini of the bi-specific protein. For example, in some embodiments, the half-life modulator is joined at the C-terminus to the N-terminus of the activator domain. In other embodiments, the half-life modulator is joined at the C-terminus of the targeting domain. In other embodiments, the half-life modulator can be joined at the N-terminus to the C-terminus of the activator domain. Yet in other embodiments, the half-life modulator can be joined at the N-terminus to the C-terminus of the targeting domain.

In some embodiments, the half-life modulator is designed to drive the size of the bi-specific fusion protein beyond about 70 kDa or equivalent radius to minimize renal clearance. In some embodiments, the half-life modulator is designed to extend the half-life of the bi-specific fusion protein through FcRn receptor-mediated recycling or through binding to serum components such as Human Serum Albumin (HSA).

Preferably, the half-life modulator is non-immunogenic in humans. The half-life modulator can be a human serum protein or a derivative thereof that retains at least 50% sequence identity over a region that consists of at least 100 consecutive amino acids. As used herein "sequence identity" means, in the context of comparing a polynucleotide or a polypeptide sequence to a reference sequence, that the polynucleotide or polypeptide sequence is the same or has a specified percentage of nucleotides or residues that are the same at the corresponding locations within the reference sequence when the polynucleotide or polypeptide sequences are optimally aligned.

In some embodiments, the half-life modulator can be modified by glycosylation of one or more glyscosylation site present in the half-life modulator. For example, the following amino acids: asparagine, serine, threonine can be added or removed to alter the glycosylation of the half-life modulator. In some embodiments, glycosylation of the half-life modulator in the bi-specific protein can modulate the half-life of the bi-specific protein. In some embodiments, the half-life modulator sequence is modified to reduce glycosylation. Such modification comprising the substitution of Asn (N) by Gln (Q) or Ala (A), and/or the substitution of Ser (S) or Thr (T) by Ala (A).

Human serum albumin (HSA) has a naturally long serum half life, in part due to its binding to FcRN and recycling. HSA is the most abundant protein in the blood and has a demonstrated safety in humans. In some embodiments, the asparagine at position 503 of HSA, which may be deamidated and decrease half life, can be removed by the N503Q substitution. In some embodiments, the cysteine C34 of HSA may be substituted to serine or alanine (S or A) to remove the free cysteine and minimize alternate disulfide-bond formation. In some embodiments, the half-life modulator is a modified version of the domain III (mHSA_dIII) of a modified HSA with the N503Q substitution and an additional terminal glycine. Such a modified version retains the HSA property of binding to FcRn and increased serum half life. In some embodiments, the half-life modulator comprises at least 100 consecutive amino acids that are at least 70%, 80%, 85%, 90% or 95% identical to a human serum albumin amino acid sequence (SEQ ID NO: 12). In some embodiments, the half-life modulator comprises the sequence recited in SEQ ID NOs: 10, 12, 24-28, 65, or 67. In some embodiments, the half-life modulator nucleic acid sequence comprises the sequence recited in SEQ ID NOs: 212-215.

In some embodiments, the half-life modulator comprises at least 100 consecutive amino acids that are at least 70%, 80%, 85%, 90% or 95% identical to a human alpha-fetoprotein (AFP) amino acid sequence (SEQ ID NOs: 29, 68). In some embodiments, the N-linked glycosylation site of the AFP is removed by the N251Q substitution. In some embodiments, the half-life modulator comprises the sequence recited in SEQ ID NOs: 29, 68, or 69. In some embodiments, the half-life modulator nucleic acid sequence comprises the sequence recited in SEQ ID NO: 216.

In some embodiments, the half-life modulator comprises at least 100 consecutive amino acids that are at least 70%, 80%, 85%, 90% or 95% identical a vitamin D-binding protein (VDBP) amino acid sequence. In some embodiments, the N-linked glycosylation site of the VDBP can be removed by the N288Q or N288T substitution. In some embodiments, the half-life modulator comprises the sequence recited in SEQ ID NO: 66. In some embodiments, the half-life modulator nucleic acid sequence comprises the sequence recited in SEQ ID NO: 219.

In some embodiments, the half-life modulator comprises at least 100 consecutive amino acids that are at least 70%, 80%, 85%, 90% or 95% identical to a human transthyretin (TTR) amino acid sequence. In some embodiments, the transthyretin is modified to remove the N118 N-glycosylation site. In some embodiments, the half-life modulator is a monomeric form of TTR.

In some embodiments, the half-life modulator comprises at least 100 consecutive amino acids that are at least 70%, 80%, 85%, 90% or 95% identical to a human Fc amino acid sequence. The Fc domain of an antibody has a natural capability to bind FcRn, resulting in an extended half-life. In some embodiments, the Fc domain of an antibody is engineered not to bind Fc(gamma)R. In an exemplary embodiment, the Fc domain is engineered to substitute N397 with Q (N297Q variant). In some embodiments, the half-life modulator is a monomeric variant form of Fc, named scFc. For example, the subset of IgG heavy chain which naturally dimerizes to form Fc is hinge-CH2-CH3. In some embodiments, the Fc domain is engineered to form a single chain by linking the hinge-CH2-CH3 with a flexible linker such as GGGGSGGGGSGGGGSGGGGS (SEQ ID NO: 104) to create a hinge-CH2-CH3-linker-hinge-CH2-CH3 chain. In an exemplary embodiment, the single chain Fc (scFc) is engineered to substitute N397 with Q and C220 with S (N297Q, C220S). In some embodiment, the scFc domain comprises a sequence recited in SEQ ID NO: 71. In some embodiments, the half-life modulator nucleic acid sequence comprises the sequence recited in SEQ ID NO: 218.

In some embodiments, the half-life modulator comprises at least 100 consecutive amino acids that are at least 70%, 80%, 85%, 90% or 95% identical to a PASylation amino acid sequence. PASylation are proline-, alanine-, and/or serine-rich sequences that mimic PEGylation (see WO2008/155134). Polypeptide stretches of proline, alanine, and/or serine form semi-structured three-dimensional domains with large hydrodynamic radius, thereby reducing clearance of fusion proteins. In some embodiments, the PASylation amino acid sequence is about 200, 300, 400, 500 or 600 amino acids long. For example, the PASylation is a 20 times repeat of the amino acid sequence ASPAAPAPASPAAPAPSAPA (SEQ ID NO: 105).

In some embodiments, the half-life modulator comprises at least 100 consecutive amino acids that are at least 70%, 80%, 85%, 90% or 95% identical to an albumin-binding domain human antibody (albudAb) amino acid sequence (SEQ ID NO: 70). Albumin-binding domain antibodies can increase the fusion protein half-life by binding non-covalently to serum albumin (see WO2008/096158). In some embodiments, the albumin-binding domain human antibody is engineered to remove the C-terminal arginine to remove the Lys-Arg Kex2 protease site. In some embodiments, the half-life modulator nucleic acid sequence comprises the sequence recited in SEQ ID NO: 217.

Representative such half-life modulators include those recited in any one of SEQ ID NOs: 10, 12, 14-29, 45-49, 65-71 or 105.

In some embodiments, the half-life modulators can be modified to substitute the cysteine residues to serine or alanine residues to reduce the ability to form disulfide bonds.

The half-life modulator may be incorporated or conjugated into a bi-specific fusion protein alone or using a short (e.g., from 2 to 20 amino acid residues) connector polypeptide. In some embodiments, the connector polypeptide is present at the N-terminus, at the C-terminus or at both the N-terminus and the C-terminus of the half-life modulator at one or both ends. Suitable short connector polypeptides for use at the N-terminal end of the linker include, for example, dipeptides such as -Gly-Ala- (GA) and -Ala-Ser- (AS). Suitable short connector polypeptides for use at the C-terminal end of the linker include, for example, dipeptides such as -Leu-Gln- (LQ) and -Thr-Gly- (TG). In some embodiments, the connectors are longer than 2 amino acids. For example, the connectors are 5, 10, 5, 20, 30, 40, 50, 60, 70, 80, 90, 100 amino acids long. Preferably, such connectors are flexible (for example glycine-rich) or structured (e.g., alpha-helix rich). In some embodiments, the connectors or polypeptide linkers have a sequence recited in SEQ ID NOs: 41-42, 87-91 or 244. In some embodiments, the connectors are based on human proteins such as transthyretin.

SEQ ID NOs: 46-49 recite the half-life modulator of SEQ ID NO: 45 with representative connector dipeptides at both the N- and C-termini. It will be apparent, however, that such short connector polypeptides and connector recited in SEQ ID NOs: 95-104 or 182-184, if present, may be located at either one or both termini of the half-life modulator.

Certain preferred half-life modulators provide a prolonged half-life of the bi-specific fusion protein, as compared to fusion protein without half-life modulator. The effect of a half-life modulator on half-life can be evaluated using an assay that determines stability under physiological conditions. For example, bi-specific fusion protein can be incubated at 37° C. in serum (e.g., human serum) for 120 hours, with samples removed at the start of incubation and every 24 hours thereafter. Binding assays as described above are then performed to detect the level of functional bi-specific fusion protein at each time point. This level is then compared to the level of bi-specific fusion protein constructed without half-life modulator (or using a different half-life modulator) to provide a half-life comparison.

Optional Elements and Representative Bi-Specific Fusion Proteins

It will be apparent that elements in addition to those described above may optionally be included in the bi-specific fusion proteins provided herein. Such elements may be present for a variety of purposes, including to facilitate expression, preparation or purification of the bi-specific fusion protein, or to perform targeting functions. For example, an N-terminal leader polypeptide may be present. Representative leader polypeptides comprise or have a sequence recited in anyone of SEQ ID NOs: 41-42, 87-91, or 244. A bi-specific fusion protein may also, or alternatively, comprise a polyhistidine (e.g., hexahistidine) tag to facilitate purification. Such a tag comprises at least six histidine consecutive amino acid residues, and may be located at the C- or N-terminus. In certain embodiments, a hexahistidine tag is included at the C-terminus of the bi-specific fusion protein. Additional amino acid residues may also be present at the junction of the polyhistidine to the remainder of the bi-specific fusion protein. Certain bi-specific fusion proteins provided herein comprise a C-terminal polyhistidine-comprising polypeptide as recited in SEQ ID NOs: 43, 44, or 92-94.

Certain bi-specific fusion proteins have a general structure that satisfies one of the following structure (shown from N-terminal to C-terminal, left to right) shown in FIGS. 33A, 33B, 33C, 33D, 33E and 33F.

Representative bi-specific fusion proteins comprise (from N-terminal to C-terminal):
(a) a leader polypeptide (e.g., comprising or having a sequence recited in SEQ ID NOs: 41-42, 87-91 or 244);
(b) a targeting polypeptide domain (e.g., comprising or having a sequence recited in SEQ ID NOs: 1, 2, 30, 31, 72, 73, 76-83 or 85-86);
(c) a optional short connector polypeptide;
(d) a half-life modulator (e.g., comprising or having a sequence recited in any one of SEQ ID NOs:10, 12, 14-29, 45-49, 65-71, or 105;
(e) a optional short connector polypeptide;
(f) an activator domain (e.g., comprising or having a sequence recited in any one of SEQ ID NOs:3-9, 32-40, and 50-64); and
(g) a polyhistidine-comprising polypeptide (e.g., a hexahistidine-comprising polypeptide, such as a polypeptide comprising or having a sequence recited in SEQ ID NO:43-44 or 92-94).

For example, certain such bi-specific fusion proteins comprise (N-terminal to C-terminal):
(a) a leader polypeptide (e.g., comprising or having a sequence recited in SEQ ID NOs: 41-42, 87-91 or 244);
(b) a targeting polypeptide domain (e.g., comprising or having a sequence recited in SEQ ID NOs: 1, 2, 30, 31, 72, 73, 76-83 or 85-86);
(c) a half-life modulator (e.g., comprising or having a sequence recited in any one of SEQ ID NOs:10, 12, 14-29, 45-49, 65-71, or 105;
(d) an optional short connector polypeptide;
(e) an activator domain (e.g., comprising or having a sequence recited in any one of SEQ ID NOs:3-9, 32-40, and 50-64); and
(f) a polyhistidine-comprising polypeptide (e.g., a hexahistidine-comprising polypeptide, such as a polypeptide comprising or having a sequence recited in SEQ ID NO:43-44 or 92-94).

Other bi-specific fusion proteins comprise (from N-terminal to C-terminal):
(a) a leader polypeptide (e.g., comprising or having a sequence recited in SEQ ID NOs: 41-42, 87-91 or 244);
(b) an activator domain (e.g., comprising or having a sequence recited in any one of SEQ ID NOs:3-9, 32-40, and 50-64);
(c) an optional short connector polypeptide;
(d) a half-life modulator (e.g., comprising or having a sequence recited in any one of SEQ ID NOs:10, 12, 14-29, 45-49, 65-71, or 105);
(e) an optional short connector polypeptide;
(f) a targeting polypeptide domain (e.g., comprising or having a sequence recited in SEQ ID NOs: 1, 2, 30, 31, 72, 73, 76-83 or 85-86);
(g) a poly-histidine-comprising polypeptide (e.g., a hexahistidine-comprising polypeptide, such as a polypeptide comprising or having a sequence recited in SEQ ID NO:43-44 or 92-94).

Still further bi-specific fusion proteins comprise (from N-terminal to C-terminal):
(a) a leader polypeptide (e.g., comprising or having a sequence recited in SEQ ID NOs: 41-42, 87-91 or 244);
(b) a half-life modulator (e.g., comprising or having a sequence recited in any one of SEQ ID NOs:10, 12, 14-29, 45-49, 65-71, or 105;
(c) an optional short connector polypeptide;
(d) an activator domain (e.g., comprising or having a sequence recited in any one of SEQ ID NOs:3-9, 32-40, and 50-64);
(e) an optional short connector polypeptide;
(f) a targeting polypeptide domain (e.g., comprising or having a sequence recited in SEQ ID NOs: 1, 2, 30, 31, 72, 73, 76-83 or 85-86);
(g) a poly-histidine-comprising polypeptide (e.g., e.g., a hexahistidine-comprising polypeptide, such as a polypeptide comprising or having a sequence recited in SEQ ID NO:43-44 or 92-94).

Still further bi-specific fusion proteins comprise (from N-terminal to C-terminal):
(a) a leader polypeptide (e.g., comprising or having a sequence recited in SEQ ID NOs: 41-42, 87-91 or 244);
(b) a half-life modulator (e.g., comprising or having a sequence recited in any one of SEQ ID NOs:10, 12, 14-29, 45-49, 65-71, or 105);
(c) an optional short connector polypeptide;
(d) a targeting polypeptide domain (e.g., comprising or having a sequence recited in SEQ ID NOs: 1, 2, 30, 31, 72, 73, 76-83 or 85-86);
(e) an optional short connector polypeptide;
(f) an activator domain (e.g., comprising or having a sequence recited in any one of SEQ ID NOs:3-9, 32-40, and 50-64);
(g) a poly-histidine-comprising polypeptide (e.g., a hexahistidine-comprising polypeptide, such as a polypeptide comprising or having a sequence recited in SEQ ID NO:43-44 or 92-94).

Still further bi-specific fusion proteins comprise (from N-terminal to C-terminal):
(a) a leader polypeptide (e.g., comprising or having a sequence recited in SEQ ID NOs: 41-42, 87-91 or 244);
(b) a targeting polypeptide domain (e.g., comprising or having a sequence recited in SEQ ID NOs: 1, 2, 30, 31, 72, 73, 76-83 or 85-86);
(c) an optional short connector polypeptide;
(d) an activator domain (e.g., comprising or having a sequence recited in any one of SEQ ID NOs:3-9, 32-40, and 50-64);
(e) an optional short connector polypeptide;
(f) a half-life modulator (e.g., comprising or having a sequence recited in any one of SEQ ID NOs:10, 12, 14-29, 45-49, 65-71, or 105);
(g) a poly-histidine-comprising polypeptide (e.g., a hexahistidine-comprising polypeptide, such as a polypeptide comprising or having a sequence recited in SEQ ID NO:43-44 or 92-94).

Still further bi-specific fusion proteins comprise (from N-terminal to C-terminal):
(a) a leader polypeptide (e.g., comprising or having a sequence recited in SEQ ID NOs: 41-42, 87-91 or 244);
(b) an activator domain (e.g., comprising or having a sequence recited in any one of SEQ ID NOs:3-9, 32-40, and 50-64);
(c) a optional short connector polypeptide;
(d) a targeting polypeptide domain (e.g., comprising or having a sequence recited in SEQ ID NOs: 1, 2, 30, 31, 72, 73, 76-83 or 85-86);
(e) a optional short connector polypeptide;
(f) a half-life modulator (e.g., comprising or having a sequence recited in any one of SEQ ID NOs:10, 12, 14-29, 45-49, 65-71, or 105);
(g) a poly-histidine-comprising polypeptide (e.g., a hexahistidine-comprising polypeptide, such as a polypeptide comprising or having a sequence recited in SEQ ID NO:43-44 or 92-94).

In some embodiments, the short connector polypeptide comprises a sequence recited in SEQ ID NOs: 95-104 or 182-184.

In some embodiments, the optional short connector polypeptide is a dipeptide (Gly-Ala; Ala-Ser; Leu-Gln; Thr-Gly) or polypeptide having an amino acid sequence listed in SEQ ID NOs: 95-104 and 182-184.

Representative bi-specific fusion protein include, but are not limited to, aDNASI1_mHSA_IGF1, aPS4A7_mHSA_IGF1, aDNASI1_mHSA_HGF(NK1), aPS4A7_mHSA_ HGF(NK1), AnxV_mHSA_FGF2, AnxV_mHSA_NRG1b(EGF), aDNASI1_mHSA_FGF2, aDNASI1_mHSA_NRG1b(EGF), AnxV_mHSA_VEGFB (111), AnxV_mHSA_VEGFB(167), AnxV_mHSA_HGF (NK1), AnxV_mHSA_IGF1, IGF1_mHSA_AnxV, HGF (NK1)_mHSA_AnxV, NRG1b(EGF)_mHSA_AnxV, FGF2_mHSA_AnxV, VEGFB(167)_mHSA_AnxV, VEGFB (111)_mHSA_AnxV, IGF1_mHSA_B7scFv, IGF1_mHSA_Syt1, IGF1_mHSA_aDNASI1, NRG1b (EGF)_mHSA_B7scFv, NRG1b(EGF)_mHSA_Syt1, NRG1b(EGF)_mHSA_aDNASI1, FGF2_mHSA_B7scFv, FGF2_mHSA_Syt1, FGF2_mHSA_aDNASI1, B7scFv_mHSA_IGF1, Syt1_mHSA_IGF1, aDNASI1_mHSA_IGF1, B7scFv_mHSA_NRG1b(EGF), Syt1_mHSA_NRG1b(EGF), B7scFv_mHSA_FGF2, Syt1_mHSA_FGF2. Representative bi-specific fusion proteins can have a sequence recited in SEQ ID NOs: 106, 108, 110, 112, 118, 120, 124, 126, 128, 130, 132, 134, 136, 140, 142, 144, 146, 148, 150, 152, 154, 156, 158, 160, 162, 164, 166, 168, 170, 172, 174, 176, 178, 180, or can be encoded by the nucleic acid having a sequence recited in SEQ ID NOs: 107, 109, 111, 113, 119, 121, 125, 127, 129, 131, 133, 135, 137, 141, 143, 145, 147, 149, 151, 153, 155, 157, 159, 161, 163, 165, 167, 169, 171, 173, 175, 179, or 181.

Representative bi-specific fusion protein comprising a non-binding targeting polypeptide include, but are not limited to, DAscFv_mHSA_IGF1, DAscFv_mHSA_HGF(NK1), AnxVm1234_mHSA_VEGFB(111), AnxVm1234_ mHSA_VEGFB(167), AnxVm1234_mHSA_HGF(NK1), AnxVm1234_mHSA_IGF1, AnxVm1234_mHSA_NRG1b (EGF), AnxVm1234_mHSA_FGF2, HGF(NK1)_mHSA_AnxVm1234, NRG1b(EGF)_mHSA_AnxVm1234, FGF2_mHSA_AnxVm1234, VEGFB(167)_mHSA_AnxVm1234, VEGFB(111)_mHSA_AnxVm1234, IGF1_mHSA_DAscFv, NRG1b(EGF)_mHSA_DAscFv, FGF2_mHSA_DAscFv, DAscFv_mHSA_NRG1b(EGF), and DAscFv_mHSA_FGF2. Representative bi-specific fusion proteins can have a sequence recited in SEQ ID NOs 114, 116, 122, 138, 185, 246, 248, 254, 258, 260, 262, 264, 272, 274, 276 or can be encoded by nucleic acid having a sequence recited in SEQ ID NOs: 115, 116, 123, 139, 186, 247, 249, 255, 259, 261, 263, 265, 273, 275 or 277.

Preparation of Bi-Specific Fusion Proteins

Bi-specific fusion proteins may be synthesized using standard techniques, including liquid- and solid-phase peptide synthesis and recombinant DNA techniques. For solid phase synthesis, the C-terminal amino acid of the sequence is attached to an insoluble support, and the remaining amino acids are added in sequence. For polypeptides longer than about 50 amino acids, shorter regions may be synthesized in this fashion and then condensed to form the longer polypeptide. Methods of forming peptide bonds by activation of a carboxyl terminal end (e.g., by the use of the coupling reagent N,N'-dicyclohexylcarbodiimide) are well known in the art.

For recombinant DNA techniques, DNA encoding the bi-specific fusion protein is prepared chemically or by isolating and ligating DNA encoding each portion of the fusion protein. The DNA coding for each segment of the bi-specific fusion protein may be isolated from known genes or synthesized de novo. Methods for direct chemical synthesis of DNA are well known in the art, and such syntheses are routinely performed using an automated synthesizer. Chemical synthesis produces a single stranded polynucleotide, which is converted into double stranded DNA by hybridization with a complementary sequence or using DNA polymerase. While chemical synthesis of DNA is generally limited to sequences that are shorter than the bi-specific fusion protein, it will be apparent that the full bi-specific fusion protein may be obtained by ligation of shorter sequences in frame. Alternatively, DNA sequences encoding the bi-specific fusion protein are prepared by cloning. Cloning techniques are well known in the art, and are amply described, for example, by standard references such as Sambrook et al., Molecular Cloning: A Laboratory Manual (3$^{rd}$ ed.), Cold Spring Harbor Laboratory Press (2001). Portions of the DNA may be ligated together in frame to generate the full length coding sequence.

Once the DNA encoding the bi-specific fusion protein is obtained, the DNA may be cloned into a vector for expression in a prokaryotic or eukaryotic host cell. Techniques for incorporating DNA into such vectors are well known to those of ordinary skill in the art. Within such an expression vector, the DNA encoding the bi-specific fusion protein is operably linked to the nucleotide sequences necessary for expression (e.g., a suitable promoter and, if necessary, a terminating signal). A promoter is a nucleotide sequence (typically located 5' to the coding sequence) that directs the transcription of adjacently linked coding sequences. A terminating signal may be a stop codon to end translation and/or a transcription termination signal. Additional regulatory element(s) (e.g., enhancer elements) may also be present within an expression vector. Such a vector is preferably a plasmid or viral vector. Preferably, an expression vector further comprises a selectable marker, which confers resistance to a selection. This allows cells to stably integrate the vector into their chromosomes and grow to form foci, which in turn can be cloned and expanded into cell lines. A variety of selectable markers are known in the art, including, for example, genes that provide resistance to ampicillin, methotrexate, mycophenolic acid, the aminoglycoside G-418, hygromycin and puromycin. Those of ordinary skill in the art are knowledgeable in the numerous expression systems available for expression of proteins including E. coli, other bacterial hosts, yeast, and various higher eukaryotic cells such as the COS, CHO, HeLa and myeloma cell lines.

Host cells are transformed or transfected with the vector that comprises the DNA encoding the bi-specific fusion protein using standard methods. Expression in the host cell results in transcription of the DNA into the corresponding mRNA, followed by translation of the mRNA to generate the bi-specific fusion protein.

Once expressed, the bi-specific fusion protein can be purified according to standard procedures, including, for example, ammonium sulfate precipitation or affinity column chromatography. Substantially pure compositions of at least about 90 to 95% homogeneity are preferred, and 98 to 99% or more homogeneity is most preferred for pharmaceutical uses. Once purified, partially or to homogeneity as desired, if to be used therapeutically, the polypeptides should be substantially free of endotoxin.

Pharmaceutical Compositions

The present invention also provides pharmaceutical compositions comprising at least one bi-specific fusion protein as described herein, together with at least one physiologically acceptable carrier. Such compositions may be used for treating patients who are suffering from, or at risk for, tissue damage, in order to prevent tissue damage, or to repair or regenerate damaged tissue. Such patients include, for example, patients who have experienced myocardial infarction, kidney damage, and/or ischemic stroke. If desired, other active ingredients may also be included within the pharmaceutical composition, such as stem cells or other agents that facilitate repair of damaged tissue.

As used herein, the term "physiologically acceptable" means approved by a regulatory agency of the Federal or a state government or listed in the U.S. Pharmacopeia or other generally recognized pharmacopeia for use in animals, and more particularly in humans. The term "carrier" refers to a diluent, adjuvant, excipient, or vehicle with which the bi-specific fusion protein is administered. Physiologically acceptable carriers can be sterile liquids, such as water and oils, including those of petroleum, animal, vegetable or synthetic origin (e.g., peanut oil, soybean oil, mineral oil, or sesame oil). Water is a preferred carrier when the pharmaceutical composition is administered intravenously. Saline solutions and aqueous dextrose and glycerol solutions can also be employed as liquid carriers, particularly for injectable solutions. Suitable pharmaceutical excipients include, for example, starch, glucose, lactose, sucrose, gelatin, malt, rice, flour, chalk, silica gel, sodium stearate, glycerol monostearate, talc, sodium chloride, dried skim milk, glycerol, propylene, glycol, water and ethanol. The composition, if desired, can also contain minor amounts of wetting or emulsifying agents, or pH buffering agents.

Pharmaceutical compositions may be formulated for any appropriate manner of administration, including, for example, parenteral, intranasal, topical, oral, or local administration, such as by a transdermal means, for prophylactic and/or therapeutic treatment. These compositions can take any of a variety of well known forms that suit the mode of administration, such as solutions, suspensions, emulsions, tablets, pills, capsules, powders, aerosols and sustained-release formulations. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical modes of administration and carriers are described in "Remington: The Science and Practice of Pharmacy," A. R. Gennaro, ed. Lippincott Williams & Wilkins, Philadelphia, Pa. ($21^{st}$ ed., 2005).

Commonly, the pharmaceutical compositions provided herein are administered parenterally (e.g., by intravenous, intramuscular, or subcutaneous injection), or by oral ingestion or topical application. For parenteral administration, the bi-specific fusion protein can either be suspended or dissolved in the carrier. A sterile aqueous carrier is generally preferred, such as water, buffered water, saline or phosphate-buffered saline. In addition, sterile, fixed oils may be employed as a solvent or suspending medium. For this purpose any bland fixed oil may be employed, including synthetic mono- or diglycerides. In addition, fatty acids such as oleic acid find use in the preparation of injectable compositions. Pharmaceutically acceptable auxiliary substances may also be included to approximate physiological conditions, such as pH adjusting and buffering agents, tonicity adjusting agents, dispersing agents, suspending agents, wetting agents, detergents, preservatives, local anesthetics and buffering agents.

In one preferred embodiment, the pharmaceutical composition is formulated for intravenous administration to a patient (e.g., a human). Typically, compositions for intravenous administration are solutions in sterile isotonic aqueous buffer. Where necessary, the composition may also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a sealed (e.g., hermetically sealed) container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

Compositions intended for oral use may be presented as, for example, tablets, troches, lozenges, aqueous or oily suspensions, dispersible powders or granules, emulsion, hard or soft capsules, or syrups or elixirs. Such compositions may further comprise one or more components such as sweetening agents flavoring agents, coloring agents and preserving agents. Tablets contain the active ingredient in admixture with physiologically acceptable excipients that are suitable for the manufacture of tablets. Such excipients include, for example, inert diluents, granulating and disintegrating agents, binding agents and lubricating agents. Formulations for oral use may also be presented as hard gelatin capsules wherein the active ingredient is mixed with an inert solid diluent, or as soft gelatin capsules wherein the active ingredient is mixed with water or an oil medium. Aqueous suspensions comprise the active materials in admixture with one or more excipients suitable for the manufacture of aqueous suspensions. Such excipients include suspending agents and dispersing or wetting agents. Dispersible powders and granules suitable for preparation of an aqueous suspension by the addition of water provide the active ingredient in admixture with a dispersing or wetting agent, suspending agent and one or more preservatives.

Oily suspensions may be formulated by suspending the active ingredients in a vegetable oil (e.g., *arachis* oil, olive oil, sesame oil or coconut oil) or in a mineral oil such as liquid paraffin. Pharmaceutical compositions may also be in the form of oil-in-water emulsions. The oily phase may be a vegetable oil or a mineral oil or mixture thereof. Suitable emulsifying agents include, for example, naturally-occurring gums, naturally-occurring phosphatides and anhydrides.

Pharmaceutical compositions may be sterilized by conventional sterilization techniques, or may be sterile filtered. Sterile aqueous solutions may be packaged for use as is, or lyophilized, the lyophilized preparation being combined with a sterile aqueous carrier prior to administration. The pH of an aqueous pharmaceutical composition typically will be between 3 and 11, more preferably between 5 and 9 or between 6 and 8, and most preferably between 7 and 8, such as 7 to 7.5.

Bi-specific fusion proteins provided herein are generally present within a pharmaceutical composition at a concentration such that administration of a single dose to a patient delivers a therapeutically effective amount. A therapeutically effective amount is an amount that results in a discernible patient benefit, such as detectable repair or regeneration of damaged tissue or diminution of symptoms of tissue damage. Therapeutically effective amounts can be approximated from the amounts sufficient to achieve detectable tissue repair or regeneration in one or more animal models exemplified in Table 3. Nonetheless, it will be apparent that a variety of factors will affect the therapeutically effective amount, including the activity of the bi-specific fusion protein employed; the age, body weight, general health, sex and diet of the patient; the time and route of administration; the rate of excretion; any simultaneous treatment, such as a drug combination; and the type and severity of the tissue damage in the patient undergoing treatment. Optimal dosages may be established using routine testing, and procedures that are well known in the art. Dosages generally range from about 0.5 mg to about 400 mg of bi-specific fusion protein per dose (e.g., 0.5 mg, 1 mg, 2 mg, 5 mg, 10 mg, 50 mg, 100 mg, 200 mg, 300 mg, or 400 mg per dose). In general, compositions providing dosage levels ranging from about 0.1 mg to about 100 mg per kilogram of body weight per day are preferred. In certain embodiments, dosage unit forms contain between from about 10 mg to about 100 mg of bi-specific fusion protein.

Pharmaceutical compositions may be packaged for treating or preventing tissue damage (e.g., for treatment of myocardial infarction or kidney damage). Packaged pharmaceutical preparations include a container holding a therapeutically effective amount of at least one pharmaceutical composition as described herein and instructions (e.g., labeling) indicating that the contained composition is to be used for treating tissue damage (such as myocardial infarction or kidney damage) in a patient. Pharmaceutical compositions may be packaged in multiple single dose units, each containing a fixed amount of bi-specific fusion protein in a sealed package. Alternatively, the container may hold multiple doses of the pharmaceutical composition.

Methods of Treatment

The pharmaceutical compositions can be administered to a patient (preferably a mammal such as a cow, pig, horse, chicken, cat, dog, or more preferably a human) to treat pathological tissue damage in the patient. Within the context of the present invention, the term "treatment" encompasses both prophylactic and therapeutic administration. In prophylactic applications, a pharmaceutical composition as described herein is administered to a patient susceptible to or otherwise at risk for developing pathological tissue damage, in order to prevent, delay or reduce the severity of tissue damage. In therapeutic applications, treatment is performed in order to reduce the severity of the pathological tissue damage or regenerate tissue after damage. In some embodiments, the pharmaceutical composition can be administered in combination with other therapeutic compositions.

Representative pathological tissue damage includes heart tissue damage (e.g., damage associated with myocardial infarction), kidney tissue damage and tissue damage following a ischemic stroke (e.g. cerebral ischemia, also known as brain ischemia, critical limb ischemia or other ischemia). In some embodiments, the pharmaceutical composition can be used to protect tissue from damage and/or to regenerate tissue and/or blood supply after tissue or organ damage.

In some embodiments, the pharmaceutical composition can be administered to prevent, delay, reduce or treat autoimmune diseases, for example, Systemic Lupus Erythematosus (SLE), also known as Lupus. SLE is an autoimmune disease where many tissues or systems are attacked and become inflamed, for example, joints, skin, liver, kidneys, blood cells, heart, lungs, nervous system, blood vessels. The immune system produces antibodies against self, particular against nuclear proteins and DNA. In some embodiments, the pharmaceutical compositions can be administered to a subject in need thereof to protect tissue from damage and regenerating tissue after damage. In some embodiments, the pharmaceutical composition can be administered in combination with existing immune-suppression or other treatments.

In some embodiments, the pharmaceutical compositions can be administered to a subject in need thereof to prevent, delay, reduce or treat Type I diabetes. In type I diabetes, the body's own immune system destroys the insulin-producing beta cells in the pancreas. In some embodiments, the pharmaceutical compositions can be administered to a subject in need thereof to regenerate beta cells. In some embodiments, the pharmaceutical compositions can be administered in combination with Type I diabetes treatments known in the art.

In some embodiments, the pharmaceutical compositions can be administered to a subject in need thereof to prevent, delay, reduce or treat tissue or organ degeneration. For example, the pharmaceutical compositions can be used to treat brain, spinal cord or nerve degeneration such as Alzheimer's disease, Parkinson's disease, Multiple sclerosis, or Amyotrophic lateral sclerosis (ALS), also known as Lou Gehrig's disease. In some embodiments, the pharmaceutical compositions can be administered in combination with existing treatments known in the art.

In some embodiments, the pharmaceutical compositions can be administered to a subject in need thereof to prevent, delay, reduce or treat bone and/or cartilage associated disease. In some embodiments, the pharmaceutical compositions can be used to regenerate bone and/or cartilage tissues. The pharmaceutical compositions can be administered in combination with existing treatments known in the art.

Any of a variety of known delivery systems can be used to administer a bi-specific fusion protein including, for example, encapsulation in liposomes, microparticles, microcapsules, recombinant cells capable of expressing the bi-specific fusion protein, receptor-mediated, or a retroviral or other nucleic acid vector. The bi-specific fusion protein may be administered by any convenient route, for example by infusion or bolus injection, by absorption through epithelial or mucocutaneous linings (e.g., oral mucosa, rectal and intestinal mucosa, etc.), and may be administered together with other biologically active agents. Administration can be systemic or local. In addition, it may be desirable to introduce the bi-specific fusion protein into the central nervous system by any suitable route, including intraventricular and intrathecal injection; intraventricular injection may be facilitated by an intraventricular catheter, for example, attached to a reservoir, such as an Ommaya reservoir. Pulmonary administration can also be employed, e.g., by use of an inhaler or nebulizer, and formulation with an aerosolizing agent.

In a specific embodiment, it may be desirable to administer the bi-specific fusion protein of the invention locally to the area in need of treatment; this may be achieved by, for example, local infusion during surgery, topical application (e.g., in conjunction with a wound dressing after surgery), by injection, by means of a catheter, by means of a suppository, or by means of an implant, said implant being of a porous, non-porous, or gelatinous material, including membranes, such as sialastic membranes, or fibers. In another embodiment, a vesicle, such as a liposome, can be used to deliver the bi-specific fusion protein. In yet another embodiment, the bi-specific fusion protein is delivered in a controlled release system; for example, such a controlled release system may be placed at or near the therapeutic target (e.g., an organ of the body that has experienced or is at risk for tissue damage). The use of such delivery systems is well known to those of ordinary skill in the art.

In some embodiments, the bi-specific fusion proteins provided herein are effective for treating pathological tissue damage at least in part due to their ability to recruit stem cells to the damaged tissue. In certain cases, sufficient stem cells may reside within the patient (e.g., resident cardiac stem cells). In certain embodiments, however, it may be beneficial to co-administer stem cells (e.g., bone marrow-derived autologous stem cells). Such stem cells may be administered before or after the bi-specific fusion protein, or may be administered simultaneously (either in the same pharmaceutical composition or in separate compositions).

In some embodiments, the bi-specific proteins provided herein are effective in enhancing tissue survival. In some embodiments, the bi-specific proteins can be administered and target a specific tissue or organ (e.g heart). The bi-specific proteins can then accumulate in the specific tissue or organ (e.g. heart as opposed to another organ) through binding of the targeting domain to the tissue associated target molecule. Once bound to the target molecule, the bi-specific fusion protein can dissociate from the target molecule, move away and re-associate to a target molecule, a growth factor receptor, or cytokine receptor of a different cell of the tissue in a paracrine-like manner (e.g. a damaged cell or an "at risk" cell).

As noted above, the optimal dose depends on certain factors known in the art, but generally ranges from about 0.5 mg to about 400 mg of bi-specific fusion protein per dose (e.g., 10 mg, 50 mg, 100 mg, 200 mg, 300 mg, or 400 mg per dose). A dose of bi-specific fusion protein (within a pharmaceutical composition as described above) can be administered therapeutically to a patient one or more times per hour, day, week, month, or year (e.g., 2, 4, 5, 6, 7, 8, 9, 10, 11, or 12 times per hour, day, week, month, or year). More commonly, a single dose per day or per week comprising an amount of bi-specific fusion protein ranging from about 0.1 mg to about 100 mg per kilogram of body weight is administered.

In other embodiments, a pharmaceutical composition comprising a bi-specific fusion protein may be administered to a patient in a dosage that ranges from about 0.1 mg per week to about 2500 mg per week, about 0.1 mg per week to about 10 mg per week, about 1 mg per week to about 100 mg per week, about 10 mg per week to about 500 mg per week, about 100 mg per week to about 2500 mg per week, about 10 mg per week to about 100 mg per week, or about 100 mg per week to about 1000 mg per week. Alternatively, a pharmaceutical composition comprising a bi-specific fusion protein may be administered at a dose that ranges from about 0.1 mg every other day to about 500 mg every other day, about 1 mg every other day to about 75 mg every other day, about 10 mg every other day to about 50 mg every other day, or about 20 mg every other day to about 40 mg every other day. A pharmaceutical composition comprising a bi-specific fusion protein may alternatively be administered at a dose that ranges from about 0.1 mg three times per week to about 100 mg three times per week, about 1 mg three times per week to about 75 mg three times per week, about 10 mg three times per week to about 50 mg three times per week, or about 20 mg three times per week to about 40 mg three times per week.

In further embodiments of a pharmaceutical composition comprising a bi-specific fusion protein is administered to a mammal (e.g., a human) continuously for 1, 2, 3, or 4 hours; 1, 2, 3, or 4 times a day; every other day or every third, fourth, fifth, or sixth day; 1, 2, 3, 4, 5, 6, 7, 8, 9, or 10 times a week; biweekly; 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 times a month; bimonthly; 1, 2, 3, 4, 5, 6, 7, 8, 9, or 10 times every six months; 1, 2, 3, 4, 5, 6, 7, 8, 9, 10, 11, 12, 13, 14, 15, 16, 17, 18, 19, or 20 times a year; or biannually. It will be apparent that a pharmaceutical composition comprising a bi-specific fusion protein may, but need not, be administered at different frequencies during a therapeutic regime.

The following Examples are offered by way of illustration and not by way of limitation. Unless otherwise specified, all reagents and solvents are of standard commercial grade and are used without further purification. Using routine modifications, the procedures provided in the following Examples may be varied by those of ordinary skill in the art to make and use other bi-specific fusion proteins and pharmaceutical compositions within the scope of the present invention.

EXAMPLES

Example 1

Preparation of a Representative Bi-Specific Fusion Protein

A bi-specific fusion protein in which targeting polypeptide domain binds to DNA and the activator domain is NRG1 is prepared. The two domains are joined by a modified human serum albumin (HSA) linker. The NRG1 is recombinantly fused to the amino terminus of the HSA linker incorporating a short connector polypeptide and the anti-DNA scFv is recombinantly fused to the carboxy terminus of the modified HSA linker incorporating an additional short connector polypeptide. The modified HSA linker contains two amino acid substitutions. A cysteine residue at position 34 of native HSA is mutated to serine in order to reduce potential protein heterogeneity due to oxidation at this site. An asparagine residue at amino acid 503 of native HSA, which may be sensitive to deamidation, resulting in decreased pharmacologic half-life, is mutated to glutamine. The modified HSA linker confers an extended circulating half-life on the bi-specific fusion protein.

Example 2

In Vitro Activity of a Bi-Specific Fusion Protein

The activity of both components of the representative bi-specific fusion protein prepared in Example 1 (in which the targeting polypeptide domain binds to DNA and the activator domain is NRG1) are tested using an ELISA designed to give activity only when both arms of the bi-specific fusion protein are bound to their substrates simultaneously. The ELISA is performed essentially as described in Stokes et al., J. Clin. Pathol. 35(5): 566-573 (1982) and Gripenberg et al., Scand. J. Immunol. 1:151-157 (1978). More specifically, 1 to 50 ng/ml solution of the bi-specific fusion protein in PBS is added to the wells of a plate pre-adsorbed with DNA (Anti-DS-DNA antibody ELISA kit (Alpha Diagnostic International, Dist by AutogenBioclear, UK) and incubated and washed according to manufacturer's directions until the step in which the detection antibody is added. At this stage, 100 µl of 1-50 ng/ml solution of Biotinylated goat anti-human NRG1-131 (R&D Systems BAF377) (antibody to the 'activator arm') in PBS/1% BSA/0.05% Tween is added to all wells and incubated for 1 hr at room temperature, washed in PBS with 0.05% Tween-20. 100 µl of Streptavidin-HRP (1:200 dilutions of stock 2 ug/ml, (R&D Systems 890803)) diluted in PBS is added to each well and incubated 30 min at room temperature. After a final wash in PBS with 0.05% Tween-20, 100 µl of SuperSignal ELISA Pico Chemiluminescent Substrate (as per manufacturer's instructions, Pierce, cat#34077) is added and luminescence (representative of positive signal) is measured on Fusion Microplate reader (Packard) or similar instrument.

The amount of signal detected is significantly higher (at least 100-fold higher) in the wells with bi-specific fusion protein than in wells without DNA or negative controls that contain a dead arm (i.e., does not contain an activator domain or targeting polypeptide domain). In addition, the signal is seen to vary with the amount of bi-specific fusion protein added to the wells.

Example 3

In Vivo Activity of a Bi-Specific Fusion Protein

The in vivo activity of the representative bi-specific fusion protein prepared in Example 1 is determined by detecting signaling changes in a molecule that is regulated by the activator domain of the fusion protein. For the activator domain in this fusion protein NRG1, activity is assessed by detection of increased phosphorylated ErbB-3 in cells of hearts treated with the bi-specific fusion compared to untreated or mock treated hearts. Myocardial infarction is generated in C57BL/6 mice by ligation of the left coronary artery (LCA) following endotracheal intubation, ventilation and thoracotomy. Coronary occlusion is confirmed by acute inspection of color change of the left ventricle wall, and ST elevation on the electrocardiogram before chest closure. Sham-operated mice undergo the same surgical procedure without LCA ligation.

Hearts from normal mice or those following induction of myocardial infarction, from both control and bi-specific fusion protein treated mice, are removed, fixed in 4% paraformaldehyde, embedded, sectioned and mounted as described in Dhein, Mohr and Delmar, Practical Methods in Cardiovascular Research, 2005, p. 473 (Springer, New York). Phospho-ErbB3 antibody (Cell Signaling Technology; Beverly, Mass.) is used for detection of Phospho-ErbB3 by immunofluorescence. A 2-fold increase or more in phospho-ErbB3 levels in treated versus untreated hearts is observed and is indicative of functional activator. The increase is in either the number (number per field, or percentage of total) of cells exhibiting signal, the intensity of signal per cell, or both.

Example 4

Tissue Damage Repair in Mice Using a Bi-Specific Fusion Protein

A composition comprising the representative bi-specific fusion protein of Example 1 is administered to a mouse following myocardial infarction, induced as described above. Administration is via intravenous injection (e.g., tail vein). Following administration, heart function is assessed as follows. Mice are anesthetized with chloral hydrate (400 mg/kg body weight, i.p.), and the right carotid artery is cannulated with a microtip pressure transducer (model SPR-671, Millar) for the measurements of left ventricular (LV) pressures and LV+ and −dP/dt in the closed-chest preparation. Measurements are compared to those obtained from untreated control mice to confirm that treatment with the bi-specific fusion protein affects heart function. A significant improvement is observed in heart function as assessed using at least one of these measurements.

Example 5

Expression and Purification of Fusion Proteins

Fusion proteins that comprise a targeting domain, a half-life modulator, and an activator domain were designed, expressed, and purified. Various combinations of targeting domains and activator domains were assembled with the mHSA (SEQ ID 10) half-life modulator in different orientations, with different short connecting polypeptide sequences, and with different polypeptide leader sequences. Synthetic DNA sequences were designed for each amino-acid sequence, taking into account the codon usage of the intended expression organism (e.g., CHO or *Pichia pastoris*), the desire to include or avoid particular restriction enzyme recognition sites, and other factors for codon optimization known in the art. DNA sequences were constructed and/or assembled into expression plasmids, the plasmids were transformed into an expression organism, and fusion proteins were overexpressed. Each fusion protein was then purified using a combination of different methods, including Cibacron Blue Sepharose chromatography, Ni affinity chromatography, anion exchange chromatography, and size exclusion chromatography.

DNA encoding complete fusion proteins or parts to be incorporated into fusion proteins (e.g. individual targeting domains, half-life modulation domains, or activator domains) was purchased from commercial sources (BioBasic, DNA 2.0). Amino acid sequences were explicitly defined. Constraints such as codon usage and restriction sites (demanded or prohibited) were conveyed to the vendor. The final DNA sequence encoding the protein of interest was selected from the theoretical pool of iso-coding sequences by the vendor in accordance with those constraints, general strategies to avoid low expression (such as avoidance of high secondary structure at the mRNA level), and vendor preferences. In some cases codon usage was tailored to CHO or *Pichia* alone. In other cases a combined codon usage table that avoids rare codons in distribution of either organism was applied. In some cases full-length fusion proteins were supplied by the vendor in an expression vector. In other cases, subcloning to an expression vector of interest was required. Subcloning manipulations were accomplished using traditional methods employing type II restriction enzymes and DNA ligase (New England Biolabs). Additional molecular cloning to produce fusions proteins with alternative combinations and orientations of targeting, activator, and half-life modulation domains was performed using these techniques as well as polymerase chain reaction (PCR). Fusion proteins were designed with one or more type-II restriction sites located at the junctions between functional domains at the DNA level for the facile replacement or rearrangement of any of the functional domains. When needed, restriction sites or linker regions were added to sequences by incorporating them in the primers used for PCR.

In some cases, proteins were expressed in *Pichia pastoris* using the PichiaPink Expression System (Invitrogen A11151 kit). Genes encoding the protein of interest were cloned in frame with the *Saccharomyces cerevisiae* α-mating factor secretion signal using the pPinkα-HC plasmid to allow for secreted expression of recombinant protein. In other cases, proteins were purified using the Selexis/CHO clonal system. Genes encoding the protein of interest were cloned into Selexis vectors and transfected into polyclonal CHO-K1 cells to allow for expression of recombinant protein. The pPinkα-HC plasmid contains a bacterial origin of replication (pUC) and resistance maker (Ampicillin) for propagation and selection of the circular plasmid in *E. coli*. It also contains the TRP2 gene, used for targeting the integration of the linearized vector during transformation into *Pichia*, and the ADE2 gene, included for complementation of adenine auxotrophy in *Pichia*. The AOX1 promoter ensures high levels of transcription upon methanol induction and the CYC1 sequence ensured efficient transcriptional termination. Integration of the plasmid into ADE2-deficient *Pichia* enabled both viability-driven selection on adenine deficient media as well as screening based on colony color. High copy integrants appeared white, whereas low copy integrants appeared pink or red due to the accumulation of purine precursors in the *Pichia* vacuole. White colonies were selected for protein production and in some cases several colonies were screened for efficiency of protein production on a small scale (milliliters) before production on a large scale (liters). pPinkα-HC plasmid map and details are available from Invitrogen.

In other cases, proteins were purified using the Selexis/CHO clonal system. An exemplary expression vector is pMP 20K (SELEXIS) and an exemplary cell line is CHO-kl-S (SELEXIS). pMP2OK employs commonly used genetic elements. Expression is driven by the human GAPD promoter. Genetic elements referred to as Matrix Attachment Regions or MAR elements control the dynamic organization of chromatin, and insulate nearby genes from the effect of surrounding chromatin thereby increasing copy number dependent, position-independent, expression of genes. MAR elements have been shown to improve the probability of isolating a clone exhibiting the desired level of expression for the production of a recombinant protein and to increase the stability of production. In addition to the expression plasmid, antibiotic resistance plasmids (such as pSV2-neo, SELEXIS) were also used to select for stable transformants. Expression plasmids were linearized (e.g., with PvuI) followed by QIAQUICK purification (QIAGEN). Lipofectamine LTX (Invitrogen) was used for transfection into CHO cells in Opti-MemI (Gibco). Transfected cells were recovered with F12Hams medium containing 10% FBS for 2 days without selection pressure, then with selection pressure for 4 days, then change to serum-free medium with selection pressure. HyClone® (Thermo Scientific) is used for the HSA-fused BBAs, with HT supplements (GIBCO).

Following expression, proteins were purified by a combination of Cibacron Blue Sepharose chromatography, Ni affinity chromatography, anion exchange chromatography, and size exclusion chromatography in accordance with manufacturer instructions (GE Healthcare). Protein production was monitored by sodium dodecyl sulfate polyacrylamide gel electrophoresis (SDS-PAGE).

Protein Expression in *Pichia pastoris* and Subsequent Purification by Chromatography.

Genes encoding the protein of interest were cloned in frame with the *Saccharomyces cerevisiae* α-mating factor secretion signal (SEQ ID 244, 245) using the pPinkα-HC plasmid (included in Invitrogen A11151 kit) to allow for secreted expression of recombinant protein. In addition, DNA encoding for a His6-tag was added to the 3' end of the gene to allow for the option of purification of the recombinant protein by Ni affinity chromatography. Briefly, plasmids were transformed into chemically competent PichiaPink Strain 2 (Invitrogen, catalog # A11154), and cultures were grown at 30° C. in a shaking incubator in BMGY (buffer complexed glycerol medium=1% yeast extract, 2% peptone, 100 mM potassium phosphate, pH 6.0, 1.34% Yeast Nitrogen Base with Ammonium Sulfate, without amino acids, 0.0004% biotin, 1% glycerol) to an OD600=2-6. At this time, the cells were pelleted, protein expression was induced by replacement of the media with BMMY (buffer complexed methanol medium=1% yeast extract, 2% peptone, 100 mM potassium phosphate, pH 6.0, 1.34% Yeast Nitrogen Base with Ammonium Sulfate, without amino acids, 0.0004% biotin, 0.5-1% methanol) at ⅕ the volume of the original cultures. Cultures were then grown at 20-30° C. in a shaking incubator for an additional 24-48 hours. Every 12-24 hours, additional methanol (to a final concentration of 0.5-1% (v/v)) was added to the cultures. At the time of harvest, cells were pelleted by centrifugation, the supernatant was collected, sterile filtered and stored at 4° C. until purification (typically within 3 days of harvest).

The following fusion proteins were purified according the methods described below IGF1_mHSA_AnxV (SEQ ID 136, 137); IGF1_mHSA_AnxVm1234 (SEQ ID 138, 139); NRG1b(EGF)_mHSA_AnxV (SEQ ID 142, 143); NRG1b (EGF)_mHSA_AnxVm1234 (SEQ ID 254, 255); FGF2_mHSA_AnxV (SEQ ID 144, 145). Recombinant proteins were purified by Ni affinity chromatography using Ni Sepharose 6 Fast Flow resin (GE Healthcare 17-5318-04; 1 mL of resin/50 mL of supernatant) by gravity flow according to the manufacturer's instructions. The flow-throughs from these purifications were then buffer-exchanged into 50 mM NaCl, 20 mM Tris, pH 7.0, using centrifugal concentrators, and loaded onto HiTrap Blue HP 1 mL cartridges (GE Healthcare, 17-0412-01) equilibrated in the same buffer. The proteins were purified according to the manufacturer's instructions using 20 mM Tris, pH 7.0, 50 mM NaCl, 30 mM sodium octanoate as the elution buffer. The eluates from Ni affinity chromatography and Blue Sepharose chromatography were combined and concentrated/buffer-exchanged into PBS (100 mM sodium phosphate, 150 mM NaCl), pH 7.2, using centrifugal concentrators. The samples were then loaded onto a HiPrep 26/60 Sephacryl S-200 High resolution column (GE Healthcare 17-1195-01), and the proteins were eluted in PBS (100 mM sodium phosphate, 150 mM NaCl), pH 7.2, at a flow rate of 1.3 mL/min. Fractions containing the protein of interested, as identified by (SDS-PAGE), were pooled and concentrated using centrifugal concentrators.

Final purity was assessed by SDS-PAGE. FIG. 1 shows a SDS-PAGE of IGF1_mHSA_AnxV (136), IGF1_mHSA_AnxVm1234 (138), NRG1b(EGF)_mHSA_AnxV (142), and NRG1b(EGF)_mHSA_AnxVm1234. Lane 1 corresponds to the protein molecular weight standards. Lanes 2, 4, 6, correspond to the protein samples under non-reducing conditions. Lanes 3, 5, 7, 9 correspond to protein samples under reducing conditions (50 mM dithiothreitol (DTT)). As shown in FIG. 1 showed, the fusion protein (SEQ ID NO 136) run at the correct molecular weight (MW) on SDS-PAGE gel (expected MW=111 kDa). The purity is >80%. In the absence of DTT, some dimer (<10% of total protein) were present, and the protein ran as a double band. Truncation could be the cause of the double band pattern observed. As shown in FIG. 1, the following proteins IGF1_mHSA_AnxVm1234 (SEQ ID NO 138), NRG1b(EGF)_mHSA_AnxV (SEQ ID NO 142), NRG1b(EGF)_mHSA_AnxVm1234 (SEQ ID NO 254) ran at the correct molecular weight (MW) on SDS-PAGE gel (expected MW=111 kDa). The purity of these fusion proteins was superior to 80%. In the absence of DTT, some dimer form of the proteins were present (<10% of total protein) and the dimers were eliminated with the addition of DTT.

After purification, the purity of FGF2_mHSA_AnxV fusion protein (SEQ ID NO 144) was about 50%. The fusion protein ran as a double band, one of which is at the correct MW (120 kDa), and one of which is at a lower MW. This result may suggest that the lower molecular weight band is a truncation product.

The recombinant fusion protein AnxV_mHSA_FGF2 (SEQ ID NO 118) was purified by Ni affinity chromatography using Ni Sepharose 6 Fast Flow resin (GE Healthcare 17-5318-04; 1 mL of resin/50 mL of supernatant) by gravity flow according to the manufacturer's instructions. The Binding/Wash Buffer consisted of 20 mM potassium phosphate, pH 7.4, 500 mM NaCl, 25 mM imidazole, and the Elution Buffer consisted of 20 mM potassium phosphate, pH 7.4, 500 mM NaCl, 450 mM imidazole. Following purification, purity was assessed by SDS-PAGE. The fusion protein ran at the correct MW on the gel (120 kDa) and showed a purity superior to 80%.

AnxV_mHSA_NRG1b(EGF) (SEQ ID 120, 121), AnxVm1234_mHSA_NRG1b(EGF) (SEQ ID 116, 117), AnxV_mHSA_IGF1 (SEQ ID 134, 135), AnxVm1234_mHSA_IGF1 (SEQ ID 114, 115), AnxVm1234_mHSA_FGF2 (SEQ ID 264, 265), IGF1_mHSA_B7scFv (SEQ ID 150, 151), aDNASI1_mHSA_FGF2 (SEQ ID 124, 125), aDNASI1_mHSA_NRG1b(EGF) (SEQ ID 126, 127), IGF1_mHSA_Syt1 (SEQ ID 152, 153), Syt1_mHSA_IGF1 (SEQ ID 170, 171), IGF1_mHSA_aDNASI1 (SEQ ID 154, 155), NRG1b(EGF)_mHSA_B7scFv (SEQ ID 156, 157) were purified according the methods described below. Blue Sepharose 6 Fast Flow resin (GE Healthcare 17-0948-03) was packed into Econo-pac (Bio-Rad 732-1010) columns (1.5 cm inner diameter; 4 mL resin/column) using standard procedures. Chromatography was performed using an 8-channel peristaltic pump. The columns were equilibrated with buffer containing 50 mM NaCl, 20 mM Tris, pH 7.0 (Blue Sepharose Wash Buffer). The conductivity of the protein expression supernatants was adjusted with deionized water to match that of the Blue Sepharose Wash Buffer (as determined using a conductivity meter). The supernatants from each protein expression culture were loaded onto the columns at 4-5 mL/min. Columns were washed with 5-10 column volumes of Blue Sepharose Wash Buffer. Protein was then eluted with 5-10 column volumes of Low Salt (LS) Elution Buffer (20 mM Tris, pH 7.1, 50 mM NaCl, 45 mM Na-Octanoate). In some cases (proteins having SEQ ID Nos 120, 116, 134, 114, 264), this elution step was divided into 5×1.5 mL fractions (A1-5) followed by 7×4 mL fractions (B1-7). Following elution with Low Salt Elution Buffer additional protein was eluted with 5 column volumes of High Salt (HS) Elution Buffer (20 mM Tris, pH 7.1, 1 M NaCl, 45 mM Na-Octanoate). Fractions were analyzed for protein content by SDS-PAGE concentrated by centrifugal ultrafiltration (Sartorius-Stedim, VS2022), and desalted into 0.1M sodium phosphate, 0.15M NaCl, pH 7.2 using PD-10 columns (GE 17-0851-01). Fractions containing the protein of interest were pooled. Fractions of the AnxV_mHSA_NRG1b(EGF) (SEQ ID 120) fusion protein was analyzed by SDS-PAGE. The purified fusion protein was about 50% pure. Analysis of the SDS-PAGE showed a double band on the gel. One of the band was at the expected MW (112 kDa) of the full length fusion protein, and one of the band was characterized by a lower MW which may suggest it was a truncation product. Fractions of the AnxVm1234_mHSA_NRG1b(EGF) (SEQ ID 116) fusion protein was analyzed by SDS-PAGE. SDS-PAGE analysis showed a purity of about 50% and a double band on the gel. One of the band was at the correct MW (112 kDa) of the full length fusion protein, and one of the band was characterized by a lower MW which may suggest it was a truncation product. Fractions of the AnxV_mHSA_IGF1 (SEQ ID 134) fusion protein was analyzed by SDS-PAGE. SDS-PAGE analysis showed a purity of about 50% and a double band on the gel. One of the band was at the correct MW (111 kDa) of the full length fusion protein, and one of the band was characterized by a lower MW which may suggest it was a truncation product. Fractions of the AnxVm1234mHSA_IGF1 (SEQ ID 114) fusion protein was analyzed by SDS-PAGE. SDS-PAGE analysis showed a purity of about 50% and a double band on the gel. One of the band was at the correct MW (111 kDa) of the full length fusion protein, and one of the band was characterized by a lower MW which may suggest it was a truncation product. Fractions of the AnxVm1234_mHSA_FGF2 (SEQ ID 264) fusion protein was analyzed by SDS-PAGE. SDS-PAGE analysis showed a purity of about 50% and a double band on the gel. One of the band was at the correct MW (120 kDa) of the full length fusion protein, and one of the band was characterized by a lower MW which may suggest it was a truncation product. Fractions of the IGF1_mHSA_B7scFv (SEQ ID 150) fusion protein was analyzed by SDS-PAGE. SDS-PAGE analysis showed a purity of more than 50% and a double band on the gel. One of the band was at the correct MW (102 kDa) of the full length fusion protein, and one of the band was characterized by a lower MW which may suggest it was a truncation product. Fusion protein aDNASI1_mHSA_FGF2 (SEQ ID NO 124) was analyzed on SDS-PAGE and showed a purity of less than 20% with a band corresponding to the correct MW (110 kDa) of the full length protein. The presence of lower MW bands suggested that the protein may be cleaved or truncated. Fusion protein aDNASI1_mHSA_NRG1b(EGF) (SEQ ID NO 126) was analyzed on SDS-PAGE and showed a purity of less than 50% with a band corresponding to the correct MW (110 kDa) of the full length protein. The presence of lower MW bands suggested that the protein may be cleaved or truncated. Fusion protein IGF1_mHSA_Syt1 (SEQ ID NO 152) was analyzed on SDS-PAGE and showed a purity of about 50% with a band corresponding to the correct MW (91 kDa) of the full length protein. The presence of lower MW bands suggested that the protein may be cleaved or truncated. Fusion protein Syt1_mHSA_IGF1 (SEQ ID NO 170) was analyzed on SDS-PAGE and showed a purity of less than 50% with a band corresponding to the correct MW (91 kDa) of the full length protein. The presence of higher and lower MW bands suggested the presence of dimeric products and truncation products. Fusion protein IGF1_mHSA_aDNASI1 (SEQ ID NO 154) was analyzed on SDS-PAGE and showed a purity of about 50% with a band corresponding to the correct MW (102 kDa) of the full length protein. Fusion protein NRG1b(EGF)_mHSA_B7scFv (SEQ ID NO 156) was analyzed on SDS-PAGE and showed a purity of less than 50% with a band corresponding to the correct MW (102 kDa) of the full length protein and a lower MW band which may correspond to a truncation product.

AnxV_mHSA (SEQ ID 252, 253) and AnxVm1234_mHSA (SEQ ID 250, 251) fusion proteins were purified according the methods described below. Proteins were precipitated from *Pichia* expression supernatant by Ammonium Sulfate (added to a final concentration of 82%). Precipitate was resuspended in PBS buffer and dialyzed against PBS overnight. Following dialysis, protein was loaded onto a HiPrep 26/60 Sephacryl S-200 High resolution column (GE Healthcare 17-1195-01) equilibrated in 50 mM NaCl, 20 mM potassium phosphate, pH 7.0. Protein was eluted in the same buffer, fractions from the elution were analyzed by SDS-PAGE, and fractions containing the protein of interest were pooled. This pooled eluate was then loaded (at a flow rate of 1 mL/min) onto a lmL HiTrap Q Sepharose Fast Flow column (GE Healthcare 17-5053-01) equilibrated in 20 mM potassium phosphate, 50 mM NaCl, pH 7.0. Protein was eluted with Elution Buffer (20 mM potassium phosphate, 500 mM NaCl, pH 7.0) over a gradient of 20 column volumes at 1 mL/min. Fractions were collected and analyzed by SDS-PAGE. Fractions containing protein of interest were pooled. Final purity was assessed by SDS-PAGE in the presence and absence of reductant. Fusion protein AnxV_mHSA (SEQ ID NO 252) was analyzed on SDS-PAGE and showed a purity of more than 90% with a band corresponding to the expected MW (104 kDa) of the full length protein. Some dimers (<10% of the total protein) were present but were eliminated in the presence of DTT. Fusion protein AnxVm1234_mHSA (SEQ ID NO 252) was analyzed on SDS-PAGE and showed a purity of more than 90% with a band corresponding to the expected MW (104 kDa) of the full length protein. Some dimers (<10% of the total protein) were present but were eliminated in the presence of DTT.

Protein Expression in Selexis/CHO Expression System and Subsequent Purification by Chromatography.

A stable Selexis CHO cell line expressing the protein of interest was cultured in serum-free media at 37° C., 5-8% CO2 in a shaking incubator. Media used for growth was: 1 L Ex-Cell™ CD CHO Fusion media (Sigma, 14365C-1000ML), 40 mL of 200 mM L-glutamine (Invitrogen, 25030-081), 10 mL 100×HT supplement (Invitrogen, 11067-030). The seeding density for the cells was 0.3-0.5×106 cells/mL. The culture was diluted once it reached 2-4×106 cells/mL, until the desired culture volume (6 L) was achieved. Cell Boost solution (1 L ddH2O, 35 g Cell Boost 5 (HyClone, 30865.01), 20 g D-glucose, adjust pH to 7.0 with NaOH) was added 3-5 days after seeding the final large culture (amount of Cell Boost=7-12% of the culture). Cell supernatant containing secreted protein of interest was harvested as soon as the culture viability dropped below 90% (~1 week after diluting the culture to its final volume). The cell supernatant was harvested by centrifugation and was sterile filtered. Supernatant was stored at 4° C. if purification was to be performed within a week, otherwise the supernatant was stored at −80° C.

Figure 14:
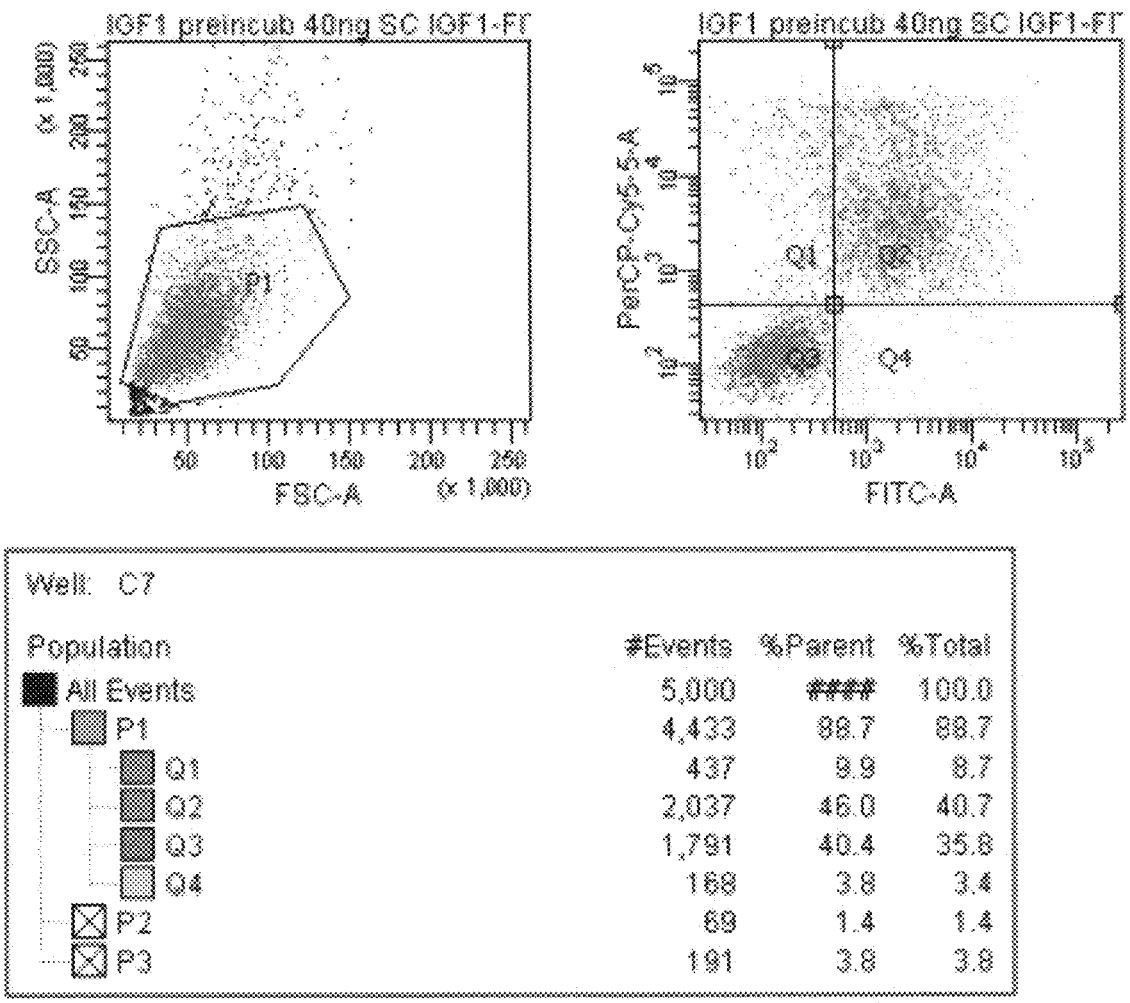
FIG. 14 is a flow cytometry of IGF1_mHSA_AnxV plus propidium iodide in apoptotic heart cells, with pre-blocking with 10 min, 800 nM IGF1.
Figure 15:
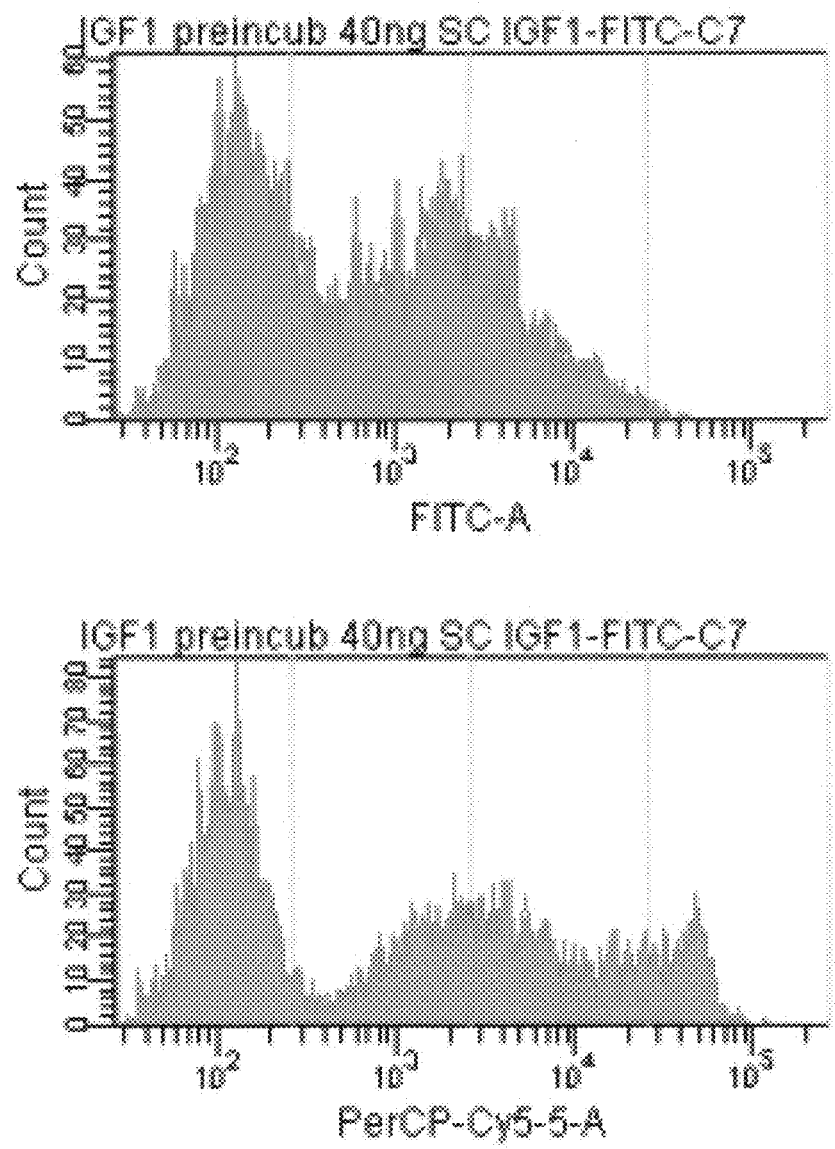
FIG. 15 is a flow cytometry histogram for the FITC and PI channels shown in FIG. 14.

Fusion proteins aDNASI1(L23)_mHSA_HGF(NK1) (SEQ ID 110, 111), DAscFv_mHSA_IGF1 (SEQ ID 246, 247), DAscFv_mHSA_HGF(NK1) (SEQ ID 248, 249) were purified according to the methods described below. Supernatant from Selexis/CHO expression was diluted 1:0.5 with ddH2O and passed over a 5 mL Blue Sepharose column twice. Protein was eluted in buffer containing 45 mM Na Octanoate then dialyzed against PBS. Protein was then diluted 1:1 with ddH2O and loaded onto a 1 mL Q anion exchange column and eluted with shallow gradient (gradient=10% B, where A=1:1 PBS:water, B=1 M NaCl in PBS, PBS=standard Dulbecco's PBS, Mg/Ca free). Fractions containing protein of interest were pooled and frozen in aliquots. Final purity was assessed by SDS-PAGE. All purified proteins showed a purity superior to 90% and ran as a single band on SDS-PAGE. FIG. 14 showed a SDS_PAGE of the aDNASI1(L23)_mHSA_HGF(NK1) (SEQ ID 110) fusion protein with a single band at the expected MW of 114 kDa. FIG. 15 showed a SDS PAGE of the DAscFv_mHSA_IGF1 (SEQ ID 246) fusion protein with a single band at the expected MW of 102 kDa. FIG. 15 showed a SDS_PAGE of the DAscFv_mHSA_HGF(NK1) (SEQ ID 248) fusion protein with a single band at the expected MW of 115 kDa.

Example 6

Specific Binding of Bi-Specific Fusion Protein to Damaged Cells

Fusion proteins that comprise a targeting domain, a half-life modulator, and an activator domain were produced, and their ability to specifically bind via their targeting domain to damaged cells in vitro was validated. The targeting domain used was human annexin V (AnxV, SEQ ID 31), which binds to phosphatidylserine which becomes exposed on the outer cell surface during apoptosis. Specific binding was demonstrated for a variety of fusion proteins, including fusion proteins with different activator domains, and fusion proteins in different fusion orientations (e.g., N-terminal activator domain with C-terminal targeting domain, and N-terminal targeting domain with C-terminal activator domain). Specific binding was also demonstrated for binding to damaged cells of different cell types, including cardiac muscle cells and embryonic stem cell-derived (ESC-derived) cardiac cells. In some cases, cells were injured with hydrogen peroxide (H2O2) to induce oxidative stress to mimic the damaged state of cells in vivo after myocardial infarction. Fusion proteins comprising a non-binding variant of annexin V (AnxVm1234, SEQ ID 84), did not bind to damaged cells, demonstrating that binding of fusion proteins was modulated by the annexin V targeting domain. Overall, these data demonstrate the capability of fusion proteins to deliver an activator domain specifically to damaged cells via the specific binding of a fused targeting domain.

Binding of fusion proteins to cells was observed using flow cytometry. Apoptotic cell death was induced by oxidative stress from treatment with hydrogen peroxide (H2O2). Apoptotic or dead cells were identified by labeling with propidium iodide (PI) or by labeling with a fluorescent Annexin V-based commercial apoptosis detection kit. In some cases, fusion proteins were first covalently labeled with a fluorescent dye for later detection. In these cases, specific binding of fusion protein to apoptotic cells was demonstrated by observing cells to be double-positive for both PI and the fusion-protein fluorescence, while equivalent cells incubated with a non-binding variant of the fusion protein were PI positive but negative for fusion-protein fluorescence. In other cases, the fusion proteins were not first covalently labeled, and instead a fluorescently-labeled secondary antibody that binds to the half-life modulator in the protein fusion was used for detecting the fusion protein. In these cases, specific binding of fusion protein to apoptotic cells was demonstrated by showing a strong correlation between the amount of fluorescent signal from the fusion protein secondary antibody to the amount of fluorescent signal from the commercial annexin V-based detection kit.

A. Specific Binding of IGF1_mHSA_AnxV to Apoptotic Heart Cells

The fusion proteins IGF1_mHSA_AnxV (SEQ ID 136) and IGF1_mHSA_AnxVm1234 (SEQ ID 138) were expressed and purified as described in Example 5. Both proteins were covalently labeled with Alexa Fluor 488 (Alexa Fluor 488 microscale protein labeling kit, Invitrogen, A30006) following the manufacturer's instructions. HL-1 cells (William C. Claycomb, Louisiana State University Health Sciences Center), a cardiac muscle cell line with characteristics of adult cardiomyocytes, were seeded in gelatin/fibronectin pre-coated 96-well plates (BD/Falcon, 353072) at 1:3 in complete medium (Claycomb medium (Sigma, 51800C), containing 10% FBS (Sigma, 12103C), 2 mM L-glutamine (Invitrogen/Gibco, 25030), 100 U/mL penicillin+100 ug/mL streptomycin (Invitrogen/Gibco, 15070), and 0.1 mM norepinephrine (Sigma, A0937)) and incubated at 37° C. and 5% CO2. Two days later, the cells were re-fed with 0.1 mL/well of medium supplemented with 400 uM H2O2 (Sigma, H1009), and incubated for 15 min at 37° C. and 5% CO2. Next, the H2O2-supplemented medium was aspirated from each well and replaced with complete medium and the cells were incubated for 20-24 hr at 37° C. and 5% CO2. The next day, medium from each well was transferred into a 96-deepwell v-bottom plate (USA Scientific, 1896-1110) to collect detached cells. The cells were washed once with PBS (Sigma, D8537) and then trypsinized using 40 uL of 0.025% Trypsin-EDTA and placed in a 37° C. incubator. Cell detachment was monitored under a microscope and 100 uL/well of DMEM plus 10% FBS was added to deactivate the trypsin. Cells were washed with cold PBS and resuspended in 100 uL of binding buffer (component of Annexin V-FITC apoptosis detection kit, BD Biosciences, 556547). Alexa Fluor 488-labeled fusion protein was then added and incubated in the dark on ice for 1 hr. Positive-control detection of apoptotic cells was obtained using an Annexin V-FITC apoptosis detection kit (BD Biosciences, 556547). In both cases, 3 uL of propidium iodide (PI) was added for the final 15 min of incubation. Cells were analyzed on a BD FACSCanto II flow cytometer, using appropriate unstained and single-stained controls for calibration.

Figure 2:
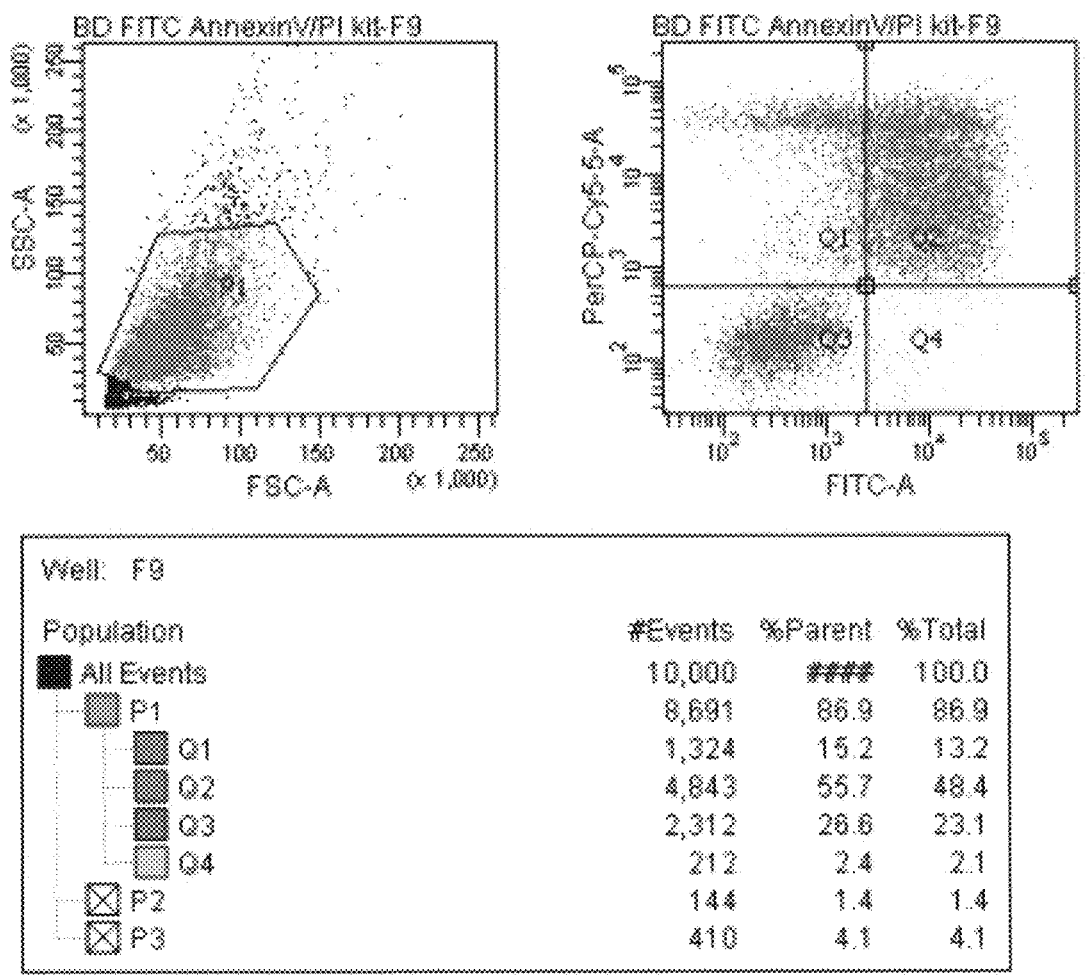
FIG. 2 is a flow cytometry of Annexin V-FITC plus propidium iodide (PI) apoptosis detection positive control in apoptotic heart cells.
Figure 3:
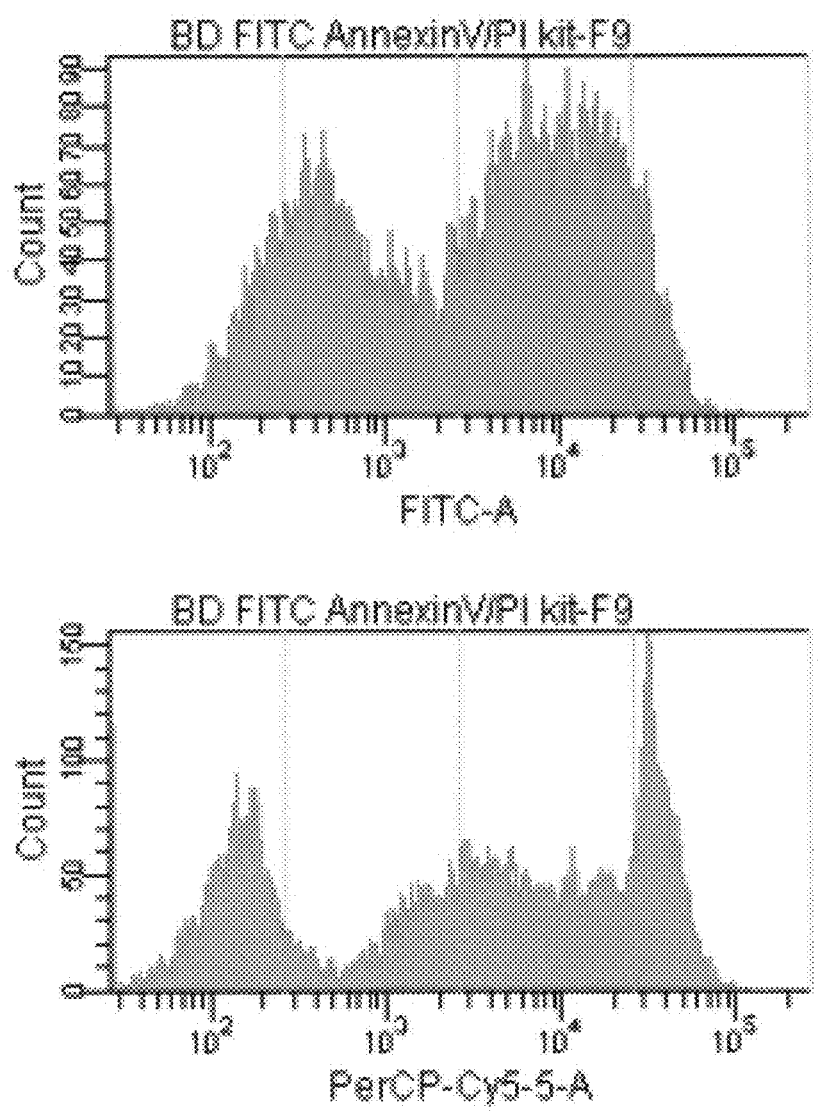
FIG. 3 is a flow cytometry histogram for the FITC and PI channels shown in the FIG. 2.
Figure 4:
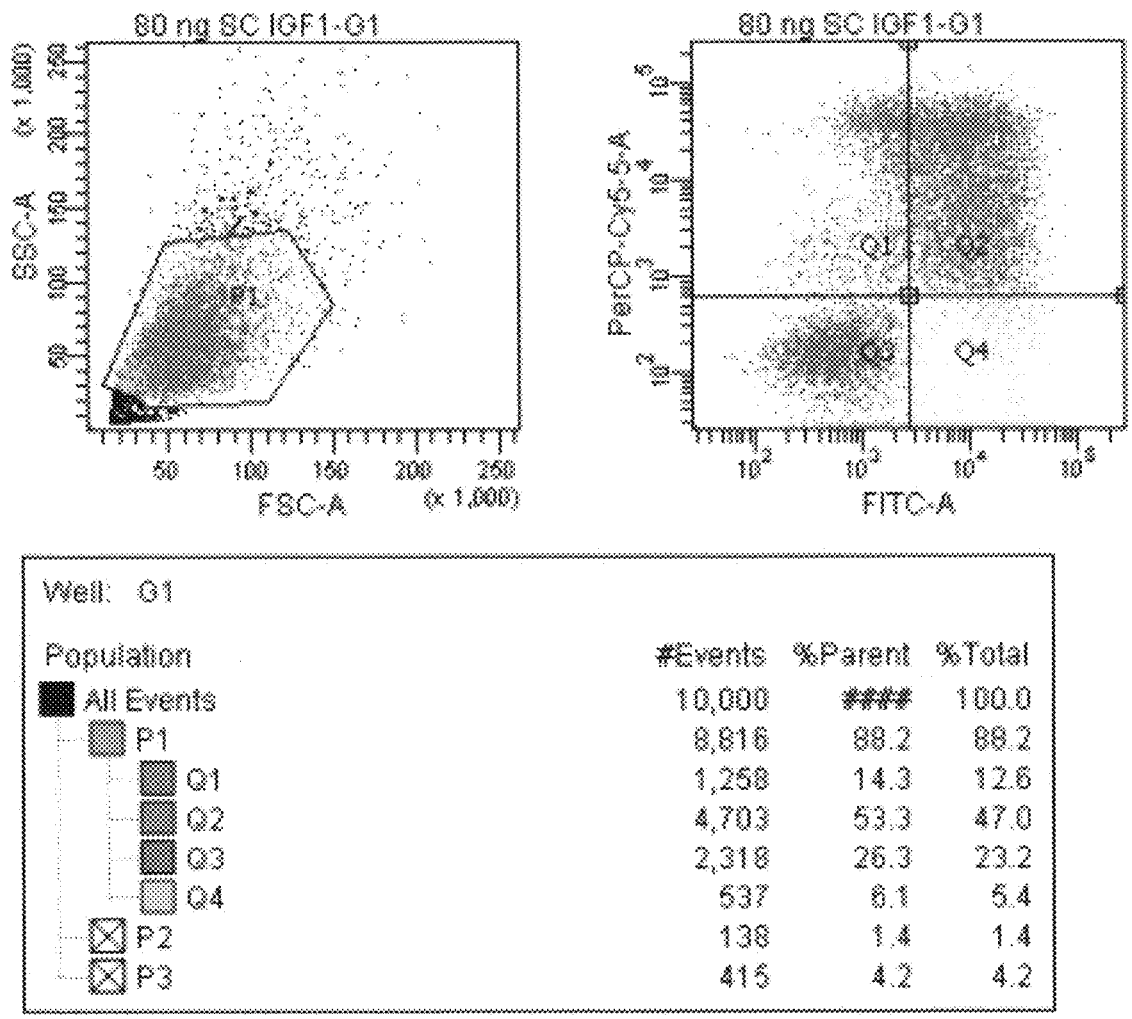
FIG. 4 is a flow cytometry of IGF1_mHSA_AnxV plus propidium iodide in apoptotic heart cells.
Figure 5:
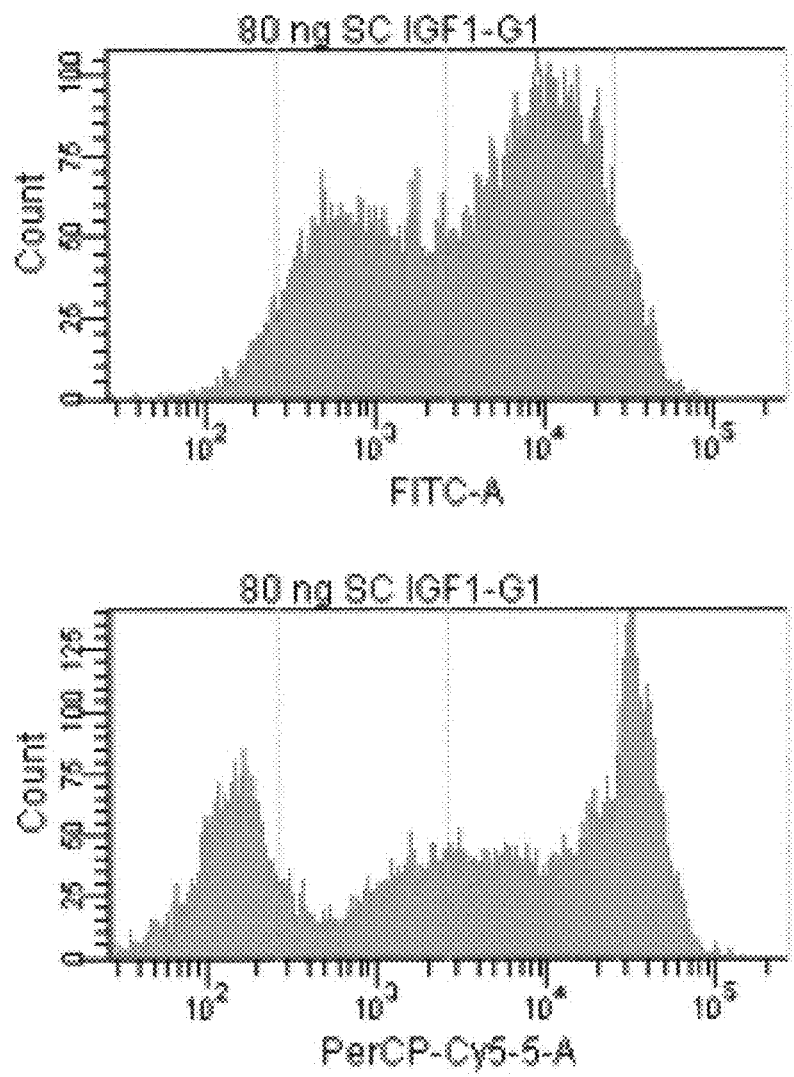
FIG. 5 is a flow cytometry histogram for the FITC and PI channels shown in FIG. 4.
Figure 6:
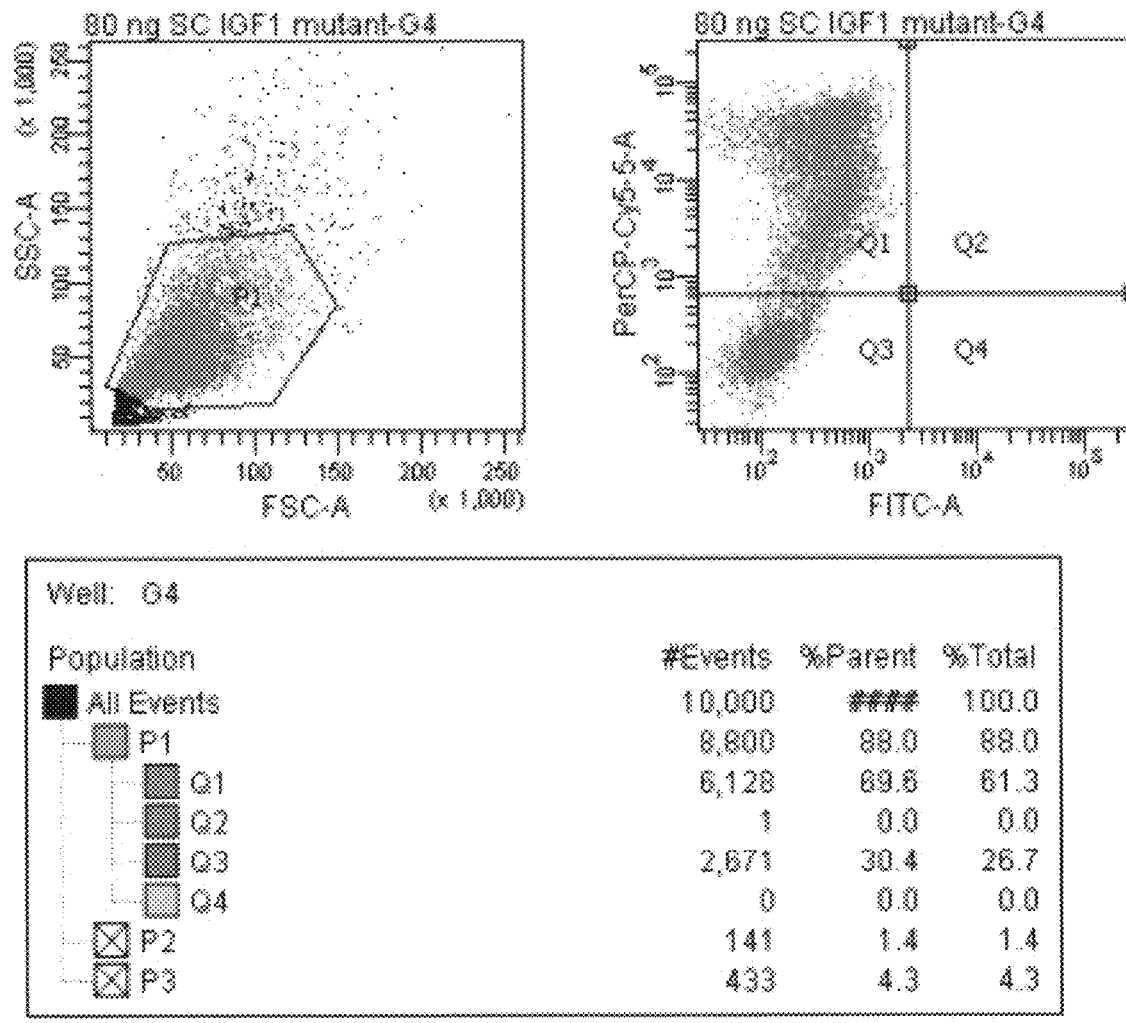
FIG. 6 is a flow cytometry of IGF1_mHSA_AnxVm1234 plus propidium iodide in apoptotic heart cells.
Figure 7:
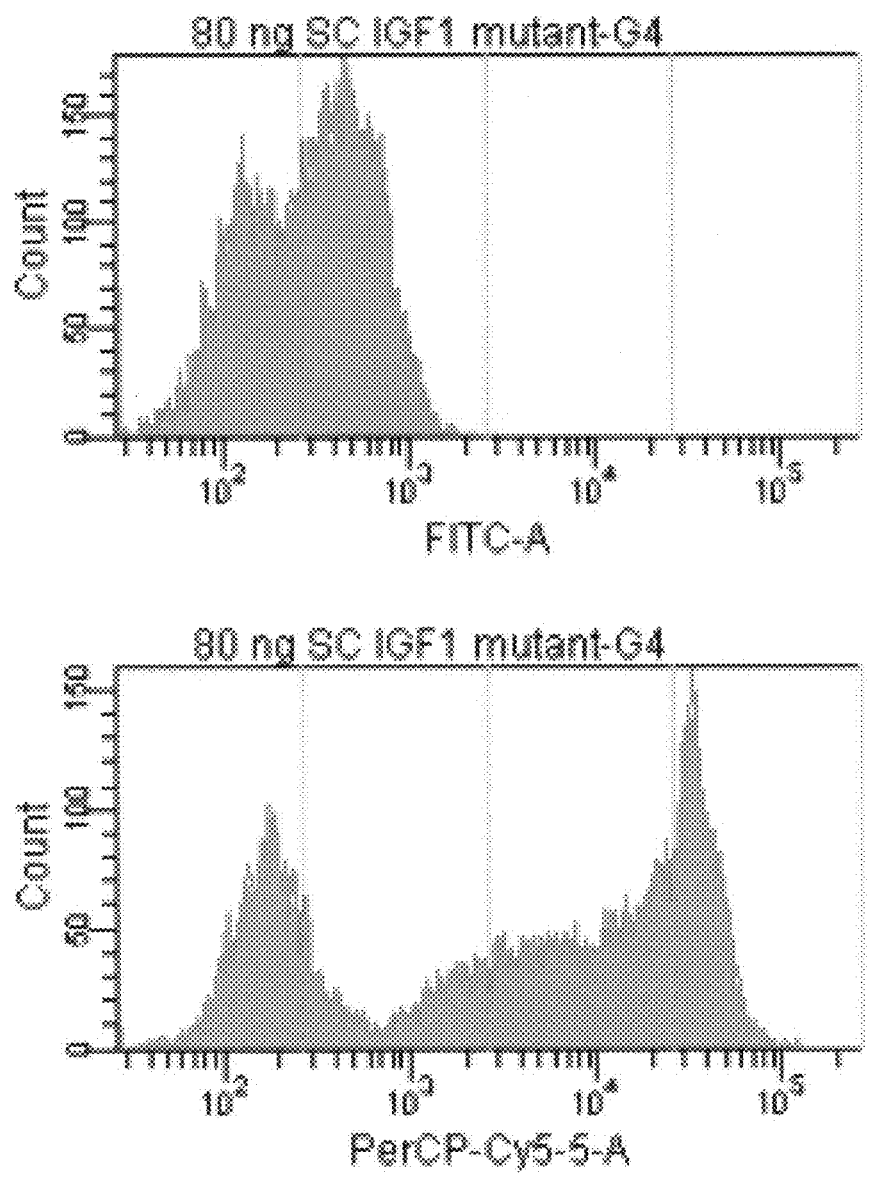
FIG. 7 is a flow cytometry histogram for the FITC and PI channels shown in FIG. 6.

Apoptotic cells were co-labeled with Annexin V-FITC and propidium iodide (PI) from the BD Biosciences apoptosis detection kit (FIGS. 2 and 3). 56% of cells were in the double-positive quadrant, indicating late apoptosis or cell death. Positive and negative populations were fairly well separated. IGF1_mHSA_AnxV (SEQ ID 136) and IGF1_mHSA_AnxVm1234 (SEQ ID 138) were each labeled with Alexa Fluor 488, achieving a degree-of-labeling (DOL) of 7.1 and 8.1 mole dye/mole protein, respectively. Apoptotic cells were also co-labeled with 80 ng (7.1 nM) of IGF1_mHSA_AnxV and PI (FIGS. 4 and 5), or 80 ng (7.1 nM) of IGF1_mHSA_AnxVm1234 and PI (FIGS. 6 and 7). The IGF1_mHSA_AnxV-labeled cells displayed a fairly well-separated double-positive peak (53% of cells), very similar to the apoptosis detection-kit positive control, indicating that the fusion protein bound specifically to apoptotic or dead cells. On the other hand, the IGF1_mHSA_AnxVm1234-labeled cells did not display a double-positive peak (0% of cells), indicating that the non-binding targeting arm did not bind to apoptotic or dead cells, as designed. Together, these data showed that a fusion protein comprising annexin V (AnxV) as a targeting domain can bind specifically to apoptotic or dead cardiac cells, and may therefore be used to deliver a fused agent or molecule having a biological (e.g. therapeutic) effect, such as an activator domain, to treat injured or damaged cardiac tissue.

B. Specific Binding of IGF1_mHSA_AnxV to Apoptotic Heart Cells

To verify that the binding to apoptotic heart cells observed in Example 6A was specific to the AnxV targeting domain in the IGF1_mHSA_AnxV fusion protein, and not a result of binding from the IGF1 domain to cell-surface IGF receptors, the experiment was repeated with the inclusion of an IGF1 pre-incubation step to saturate and block any/all IGF1 cell surface receptors. The methods used were the same as in Example 6A, except that the H2O2 concentration was changed to 200 In addition, after resuspension of the cells in binding buffer, but prior to addition of Alexa Fluor 488-labeled fusion protein, 800 nM of IGF1 (Calbiochem, 407240) was added and incubated for 10 min to pre-block any/all IGF1 cell surface receptors with IGF1.

Figure 8:
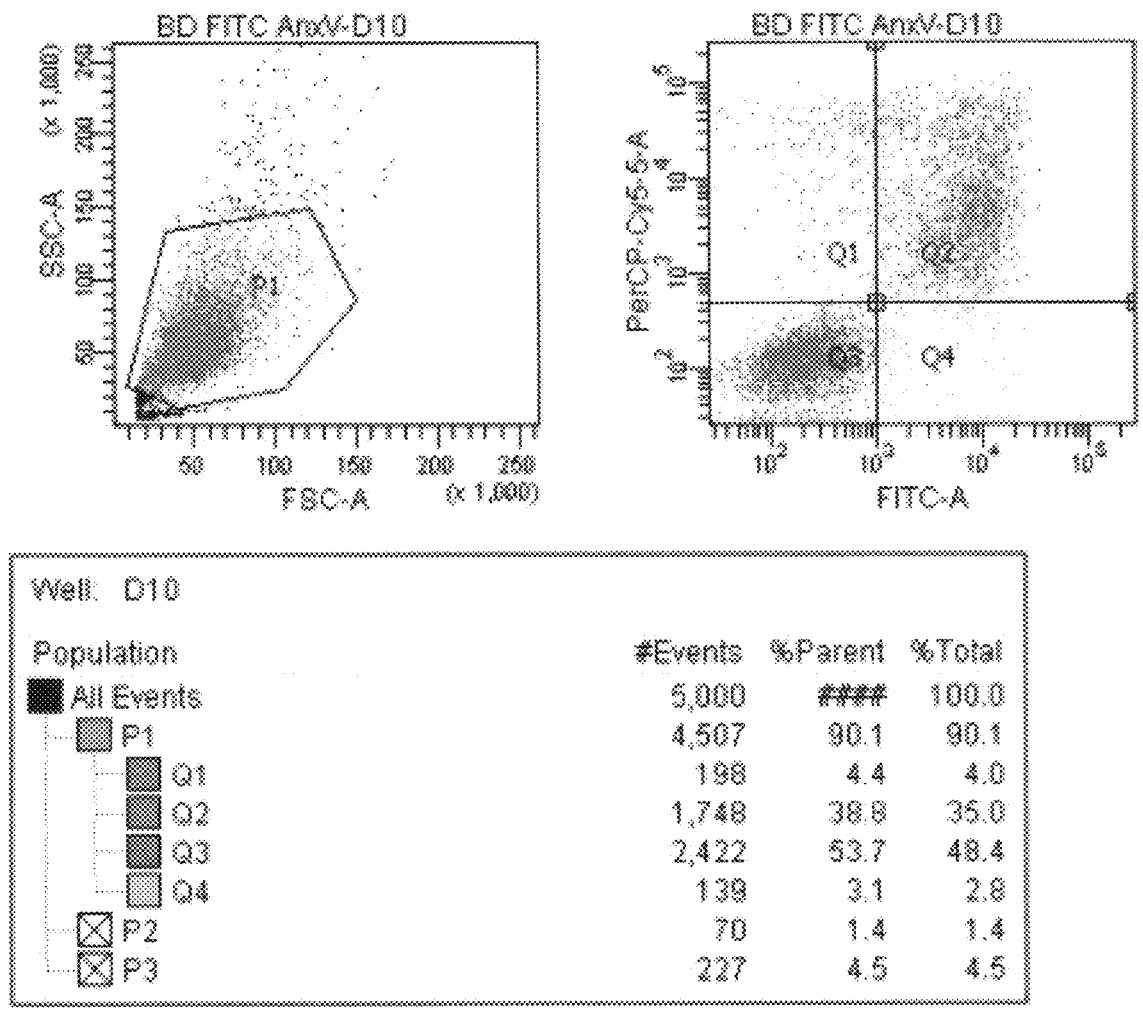
FIG. 8 is flow cytometry of Annexin V-FITC plus propidium iodide (PI) apoptosis detection positive control in apoptotic heart cells.
Figure 9:
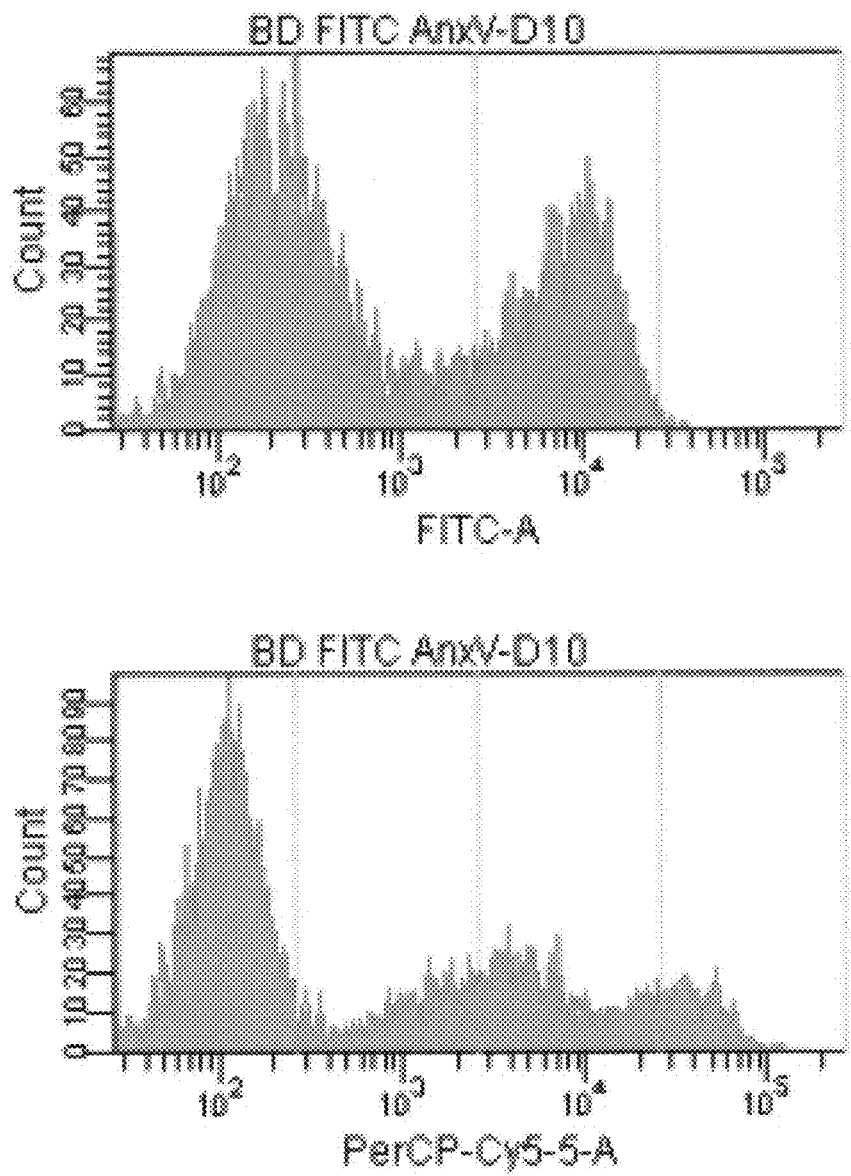
FIG. 9 is a flow cytometry histogram for the FITC and PI channels shown in FIG. 8.
Figure 10:
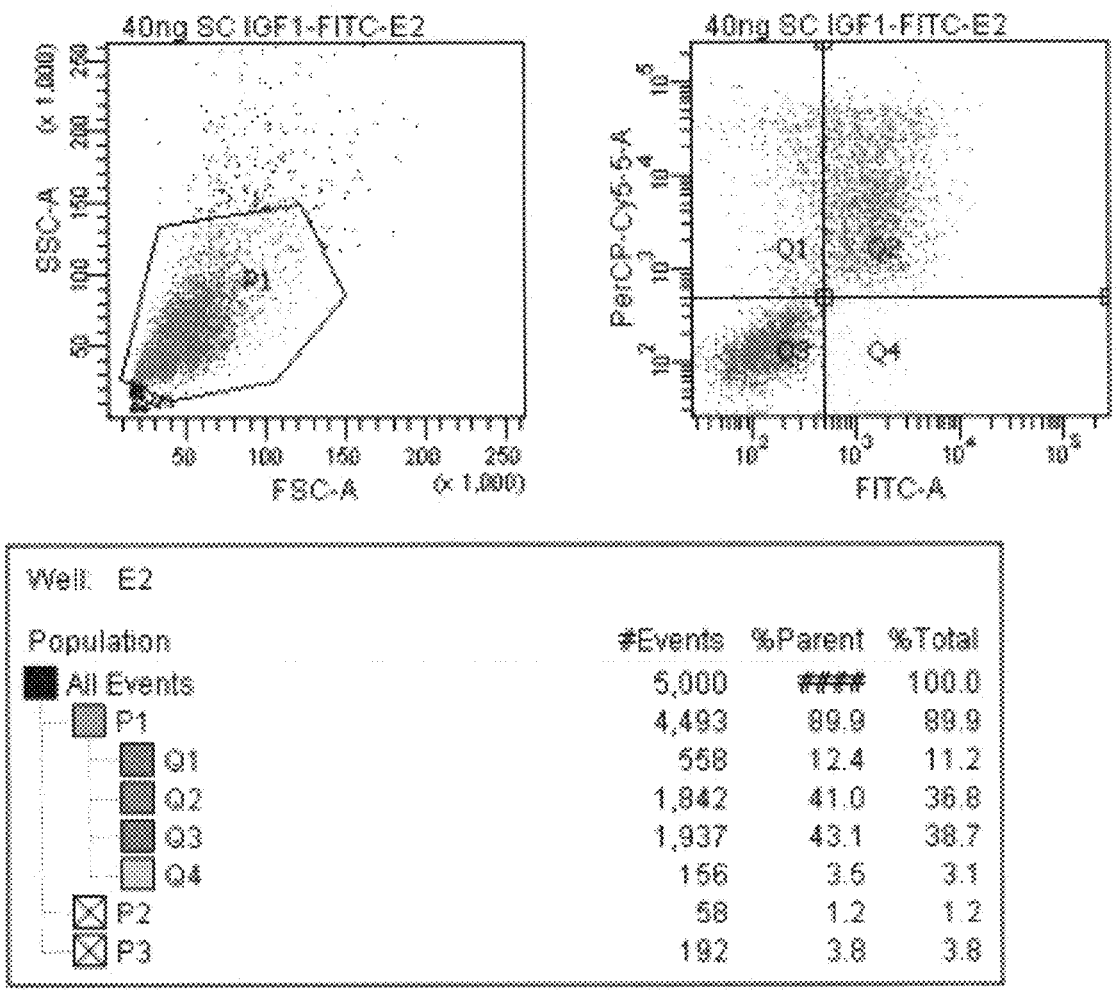
FIG. 10 is a flow cytometry of IGF1_mHSA_AnxV plus propidium iodide in apoptotic heart cells, without pre-blocking with IGF1.
Figure 11:
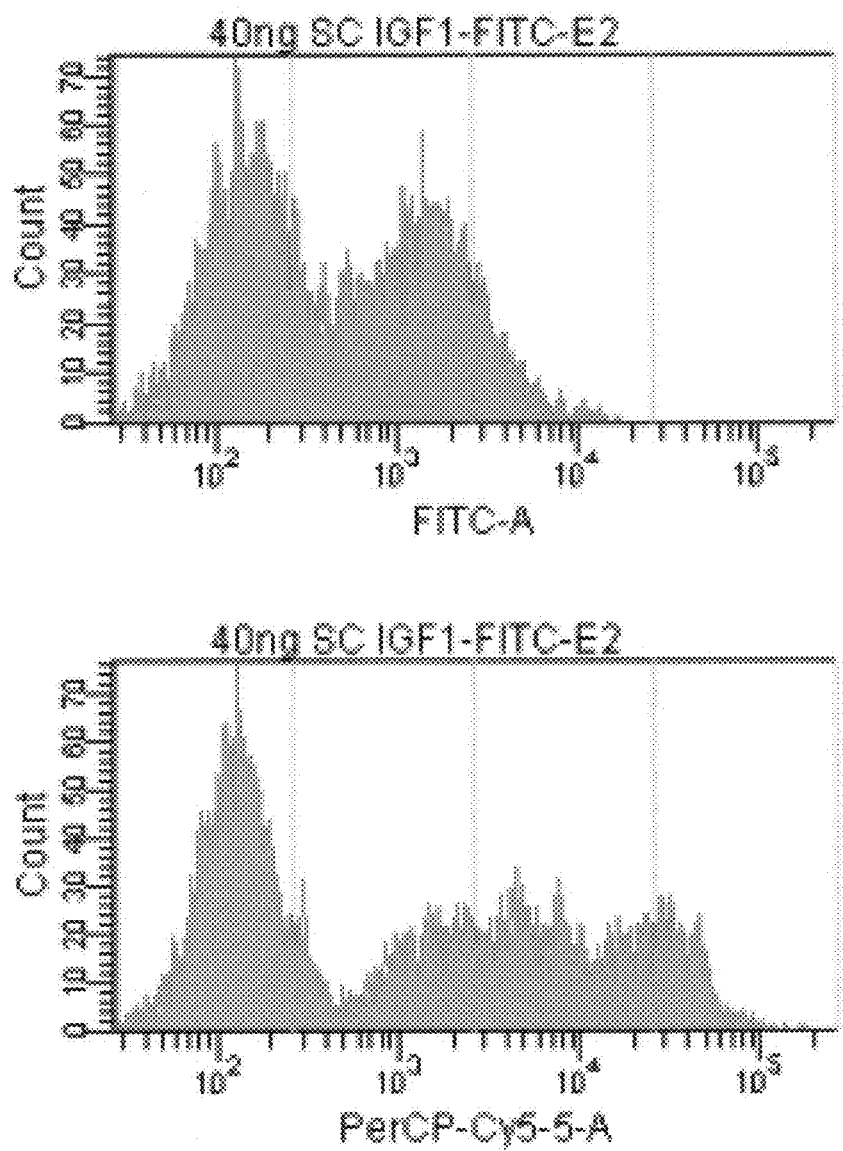
FIG. 11 is a flow cytometry histogram for the FITC and PI channels shown in FIG. 10.
Figure 12:
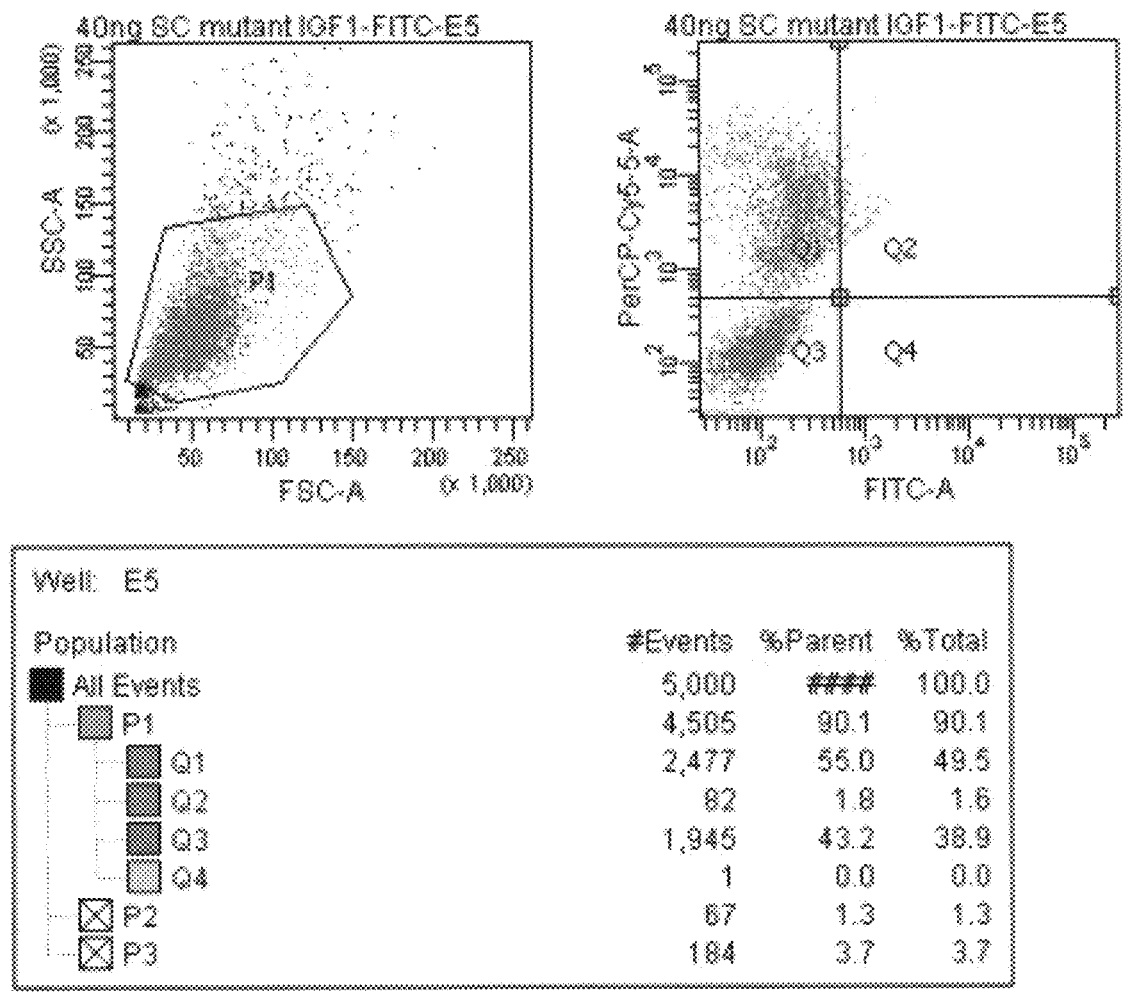
FIG. 12 is a flow cytometry of IGF1_mHSA_AnxVm1234 plus propidium iodide in apoptotic heart cells, without pre-blocking with IGF1.
Figure 13:
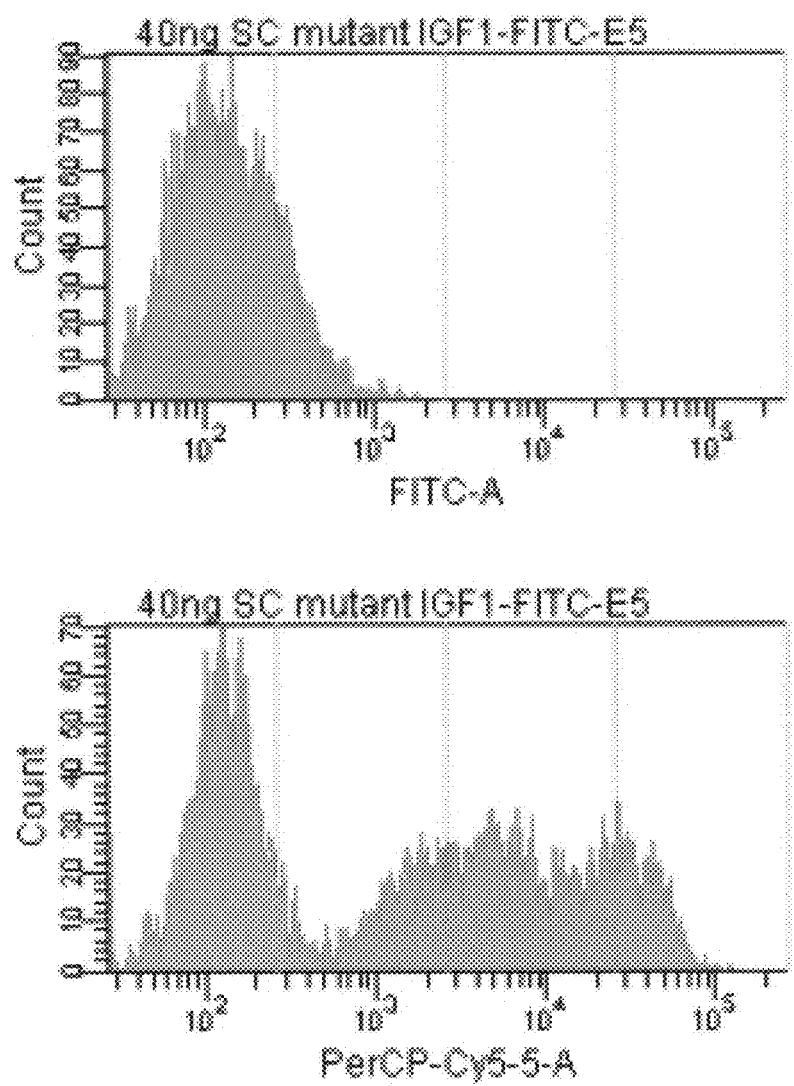
FIG. 13 is a flow cytometry histogram for the FITC and PI channels shown in FIG. 12.

The Annexin V-FITC plus PI positive control in FIGS. 8 and 9 showed that approximately 40% were double-positive, indicating late apoptosis or cell death population. FIGS. 10 and 11 demonstrated binding of IGF1_mHSA_AnxV to apoptotic cells, while the non-binding control fusion, IGF1_mHSA_AnxVm1234, did not bind (FIGS. 12 and 13), as shown in Example 6A. Next, to demonstrate that IGF1_mHSA_AnxV did not appreciably bind to cells via its IGF1 domain, the assays were repeated with the IGF1 blocking step. FIGS. 14 and 15 showed the binding of IGF1_mHSA_AnxV to apoptotic cells, even in the presence of, and after incubation with, excess IGF1. These data demonstrated that the AnxV targeting domain was responsible for the specific binding of protein fusions to apoptotic cells.

C. Specific Binding of AnxV_mHSA to Apoptotic ESC-Derived Cardiac Cells

AnxV_mHSA (SEQ ID 252) and AnxVm1234_mHSA (SEQ ID 250) were directly conjugated to Alex Fluor 647 (Alexa Fluor 647 carboxylic acid, succinimidyl ester, Invitrogen, A-20006) following the manufacturer's instructions. Embryonic stem cell-derived (ESC-derived) cardiac cells (Peter Zandstra, University of Toronto) were derived essentially as described in Yang et al (Nature 2008, 453:524-8). Protocol was derived from Bauwens C L, et al. Tissue Eng Part A. 2011 Apr. 25., Geometric Control of Cardiomyogenic Induction in Human Pluripotent Stem Cells." Aggregate-based differentiation of hESCs was carried out using a protocol for serum-free directed differentiation to the cardiac lineage which has been previously described. HESC aggregate size was controlled by forced aggregation of defined cell concentrations in AggreWell™ inserts (STEMCELL Technologies) containing a textured surface of micro-wells. Briefly, a single cell suspension of feeder depleted hESCs was spun down into Aggrewells at a density of 1000 cells/microwell. Cells were allowed to aggregate in hypoxic conditions over night in StemPro34 supplemented with Glutamax, ascorbic acid, transferrin, pen/strep as base media, with the addition of ROCK inhibitor and 0.5 ng/ml BMP4. On day 1 the media was replaced by base media with 10 ng/ml BMP4, 3 ng/ml Actvin A and 5 ng/ml bFGF. On day 4, cells were removed from the micro-wells, washed with DMEM F12 supplemented with 5% KOSR and transferred to low cluster plates in base media with 10 ng/ml VEGF and 150 ng/ml Dkk1. On day 8 the media was replaced by base media with 10 ng/ml VEGF, 150 ng/ml Dkk1 and 5 ng/ml bFGF. On day 12 the media was replaced again (same cytokines) and cells were transferred to normoxic conditions until day 16.

Figure 16:
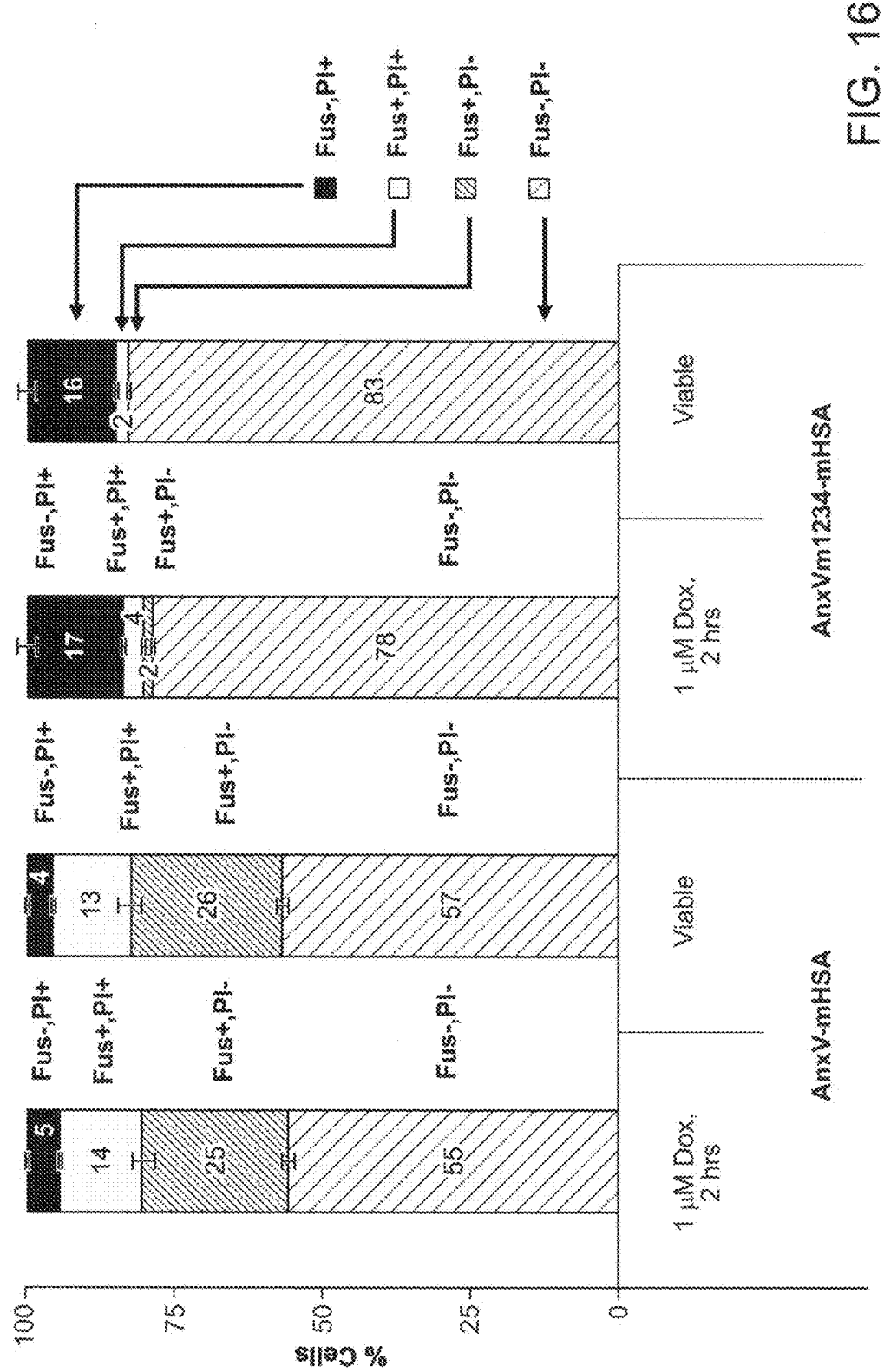
FIG. 16 is a graph showing that ESC-derived cardiac cells exhibit an apoptotic population, with or without doxorubicin treatment. Ann-HSA=AnxV_mHSA. M1234-Ann-HSA=AnxVm1234_mHSA.
Figures 17, 17A:
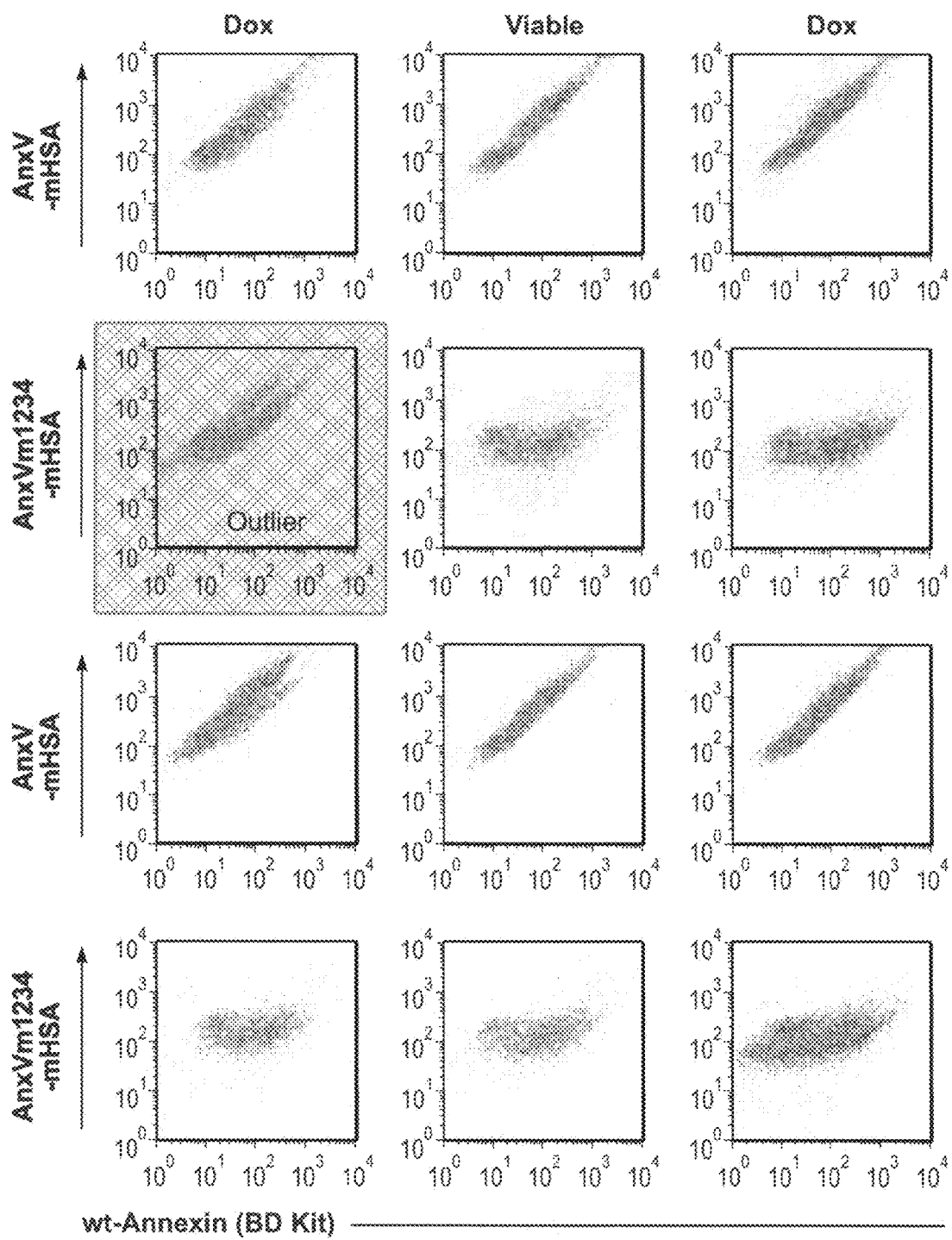
FIG. 17 is a flow cytometry showing the specific binding of AnxV_mHSA, and not AnxVm1234_mHSA, to apoptotic, ESC-derived cardiac cells.
Figure 17B:
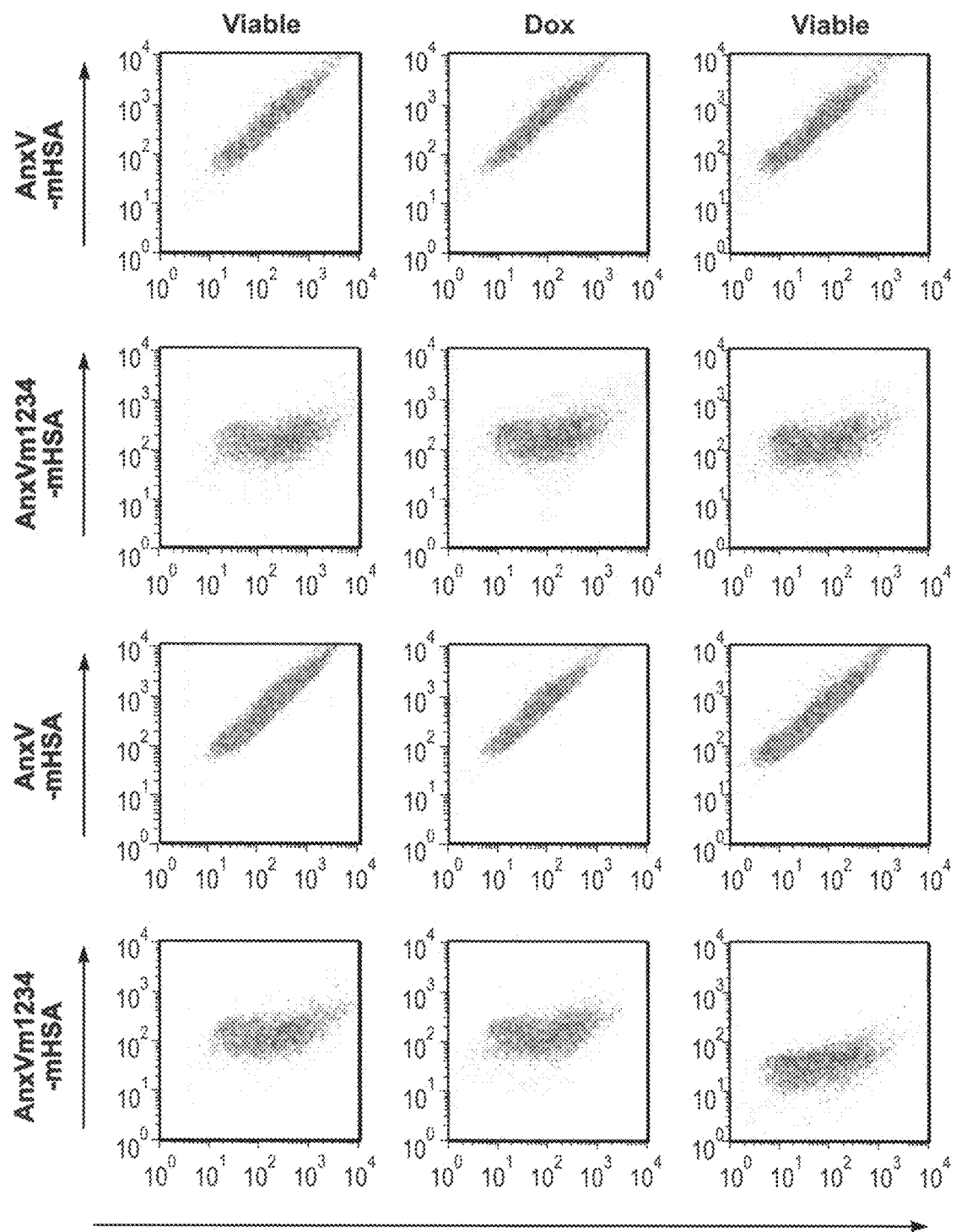

Even without H2O2 or doxorubicin treatment, the cardiac cells exhibit a measureable apoptotic population, based on PI labeling and the Annexin V-FITC detection kit (FIG. 16). Further addition of doxorubicin did not increase the apoptotic fraction. Nevertheless, apoptotic cell population was sufficient for testing the binding of apoptosis-targeting fusion proteins. The cardiac cell population was incubated with either AnxV_mHSA or AnxVm1234_mHSA, while being co-incubated with the Annexin V-FITC detection kit as well. The fluorescent signal from the Alexa Fluor 647 on the Anx-V_mHSA fusion, and not from the AnxVm1234_mHSA fusion, correlated strongly with the FITC signal from the apoptosis detection kit (FIG. 17), demonstrating that Anx-V_mHSA binds specifically to apoptotic ESC-derived cardiac cells.

Figure 18B:
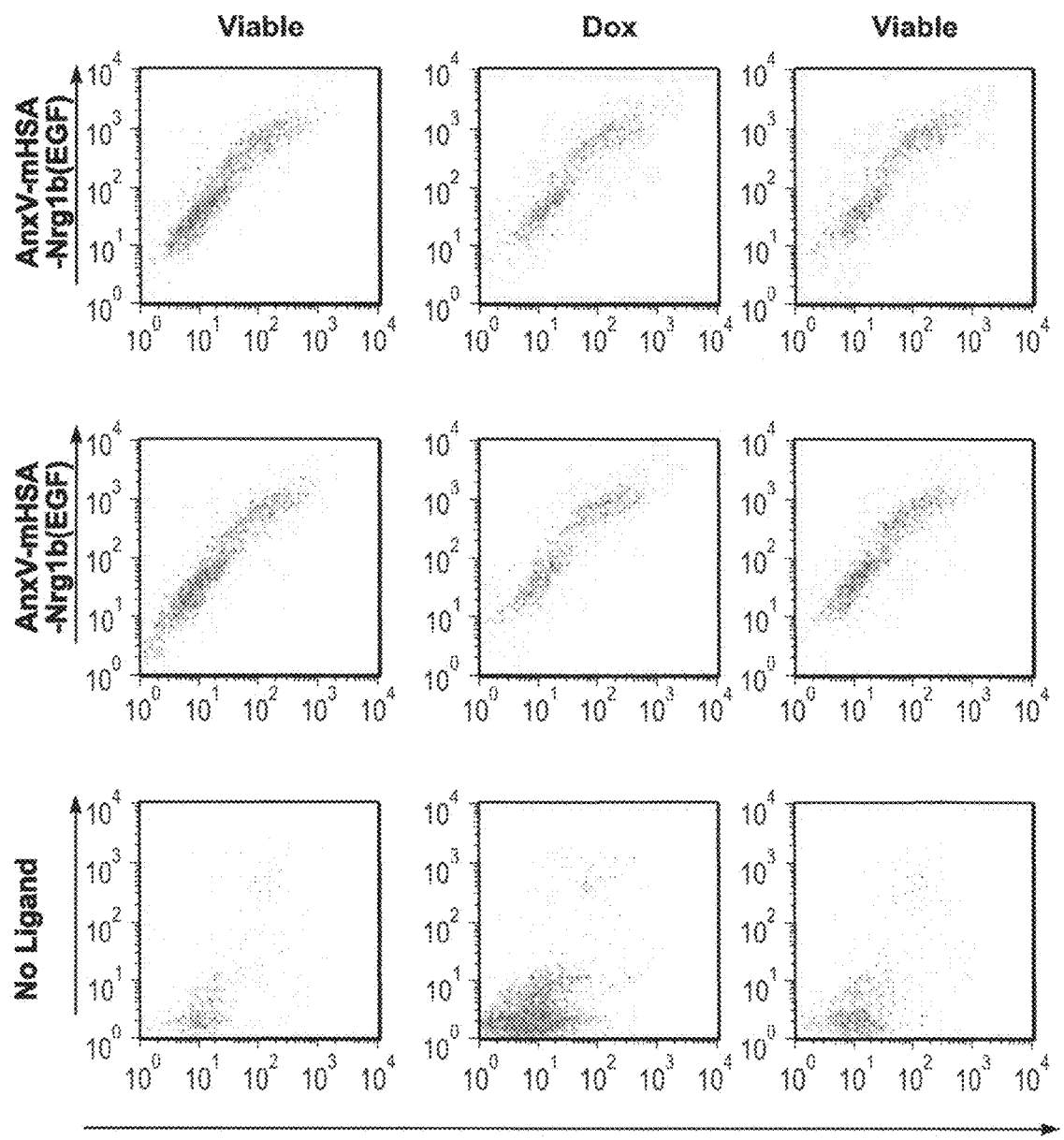
FIG. 18 is a flow cytometry showing the specific binding of AnxV_mHSA_NRG1b(EGF) to apoptotic ESC-derived cardiac cells.

D. Specific Binding of AnxV_mHSA_NRG1b(EGF)_to Apoptotic ESC-Derived Cardiac Cells Binding of the fusion protein AnxV_mHSA_NRG1b (SEQ ID 120) to apoptotic ESC-derived cardiac cells was demonstrated using a secondary detection scheme, instead of first altering the fusion protein with a covalently attached fluorophore. The fusion protein was detected using an anti-HSA antibody (goat anti-human albumin antibody affinity purified, Bethyl Labs, A80-129A) that was itself covalently labeled with Alexa Fluor 647 (Alexa Fluor 647 carboxylic acid, succinimidyl ester, Invitrogen, A-20006) following the manufacturer's instructions. Cardiac cells were incubated with AnxV_mHSA_NRG1b(EGF), while being co-incubated with the Annexin V-FITC detection kit as described in Example 6C. The fusion protein was detected by the anti-HSA Alexa Fluor 647 secondary antibody. Fluorescent signal from the Alexa Fluor 647 correlated strongly with the FITC signal from the detection kit (FIG. 18). This demonstrated that AnxV_mHSA_NRG1b(EGF) binds to apoptotic ESC-derived cardiac cells. Furthermore, a control experiment that excluded fusion protein ("No Ligand" in FIG. 18), but still incubated with secondary detection reagents, did not exhibit any correlation of Alexa Fluor 647 signal to the apoptosis-based FITC signal, demonstrating that the original Alexa Fluor 647 fluorescent signal was due to binding of the fusion protein itself and not due binding of the secondary antibody alone.

Example 7

Specific Binding of Fusion Proteins to their Targets

The process of localizing therapeutics to a disease-related area of the patient can be accomplished by targeting molecular epitopes that are either restricted to, or particularly abundant in, the area of interest. For example, myocardial infarction can expose several target molecules (e.g. DNA, cardiac myosin, and phosphatidylserine) upon tissue damage that can be exploited for this purpose. Several fusion proteins were produced that comprise targeting domains specific for these target molecules. In particular, annexin V and synaptotagmin can be used to target phosphatidylserine, and the SI-1 single-chain variable fragment (aDNASIscFv) can be used to target DNA. However, one skilled in the art will appreciate that the inclusion of a binding domain in a fusion protein may result in the loss or change of properties of each individual domain (e.g. change in binding affinity, change in biological activity). To determine if functionality can be maintained in the fusion proteins disclosed herein, an ELISA-based in vitro binding test was developed and applied. Essentially, the assay showed that targeting-competent fusion proteins were retained in microplate wells, despite stringent washing, due to their interaction with cognate target molecules lining the well surfaces. The presence of fusion protein was quantified immunochemically. In the absence of cognate target molecule, or presence of non-cognate target molecules, retention was not expected, in the absence of unexpected targeting domain cross reactivity. The combination of retention with cognate target molecule, and clearance without, was taken as proof of binding specificity and targeting function.

Microplates (Pierce 15041) were coated with the epitopes of interest. Phosphatidylserine (PS, Avanti Polar Lipids 840032) was deposited by evaporating to dryness 50 μL/well of a 12.5 μg/mL solution in Methanol. DNA (Sigma D3664) was deposited by adding 50 μL of a pre-mixed 1:1 solution of DNA at 10 μg/mL and DNA Coating Reagent (Pierce 17250) to wells. Myosin was deposited by incubating a 10 μg/mL solution in Dublecco's PBS. All coating reactions were performed at room temperature for 2 hours with 200 rpm shaking. After washing, 250 μL/well of protein-free blocking buffer (Pierce 37572) was added and plates incubated at room temperature for 3-4 hours. After further washing, 100 μL of chromatographically purified fusion proteins were added to wells at concentrations ranging from 160 ng/mL-20 μg/mL. Binding proceeded for two hours at room temperature in 10 mM Hepes, 140 mM NaCl, 2.5 mM CaCl2, pH 7.4. After further washing, 100 uL detection antibody (Goat anti-Human Albumin Antibody HRP Conjugated, Bethyl Labs A80-129P) was added to wells at dilutions of either 1:5,000 or 1:50,000 in PBST and incubated for 30-60 minutes. After further washing, 75 μL peroxidase substrate (Pierce TMB Ultra 34028) was applied, and upon the observation of significant color development, the reaction quenched with 75 μL of Stop solution (KPL 50-85-05). Absorbance of wells was read at 450 nm in a plate reader (Tecan M200 Pro). All fusion proteins and antibody combinations were performed in triplicate. All wash steps consisted of four cycles of dispensing and aspirating 2504 PBST with five second soak and shake steps between cycles using an automated 96 well plate washer (Biotek, Elx405). Mock coated blank wells (solvent, coating reagent, or buffer only) and wells without fusion protein were included as negative controls.

Figure 19:
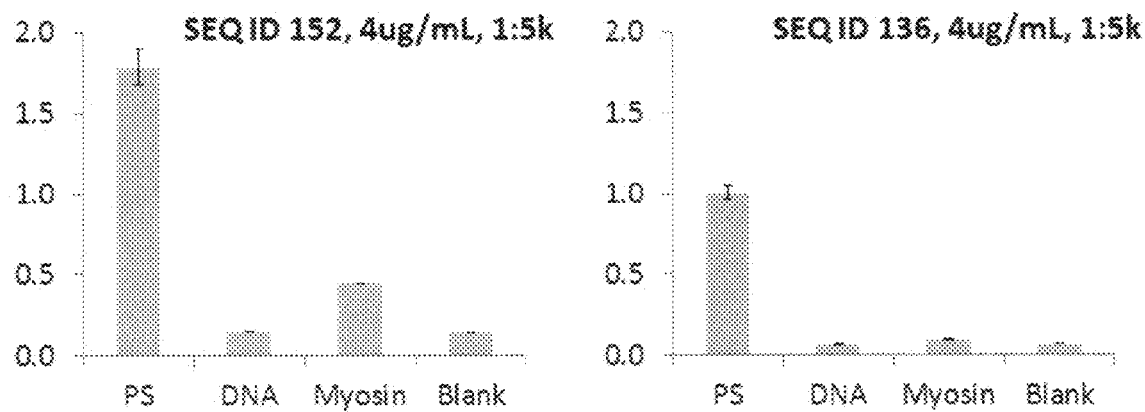
FIG. 19 are graphs showing the specific binding of IGF1_mHSA_Syt1 and IGF1_mHSA_AnxV to phosphatidylserine.
Figure 20:
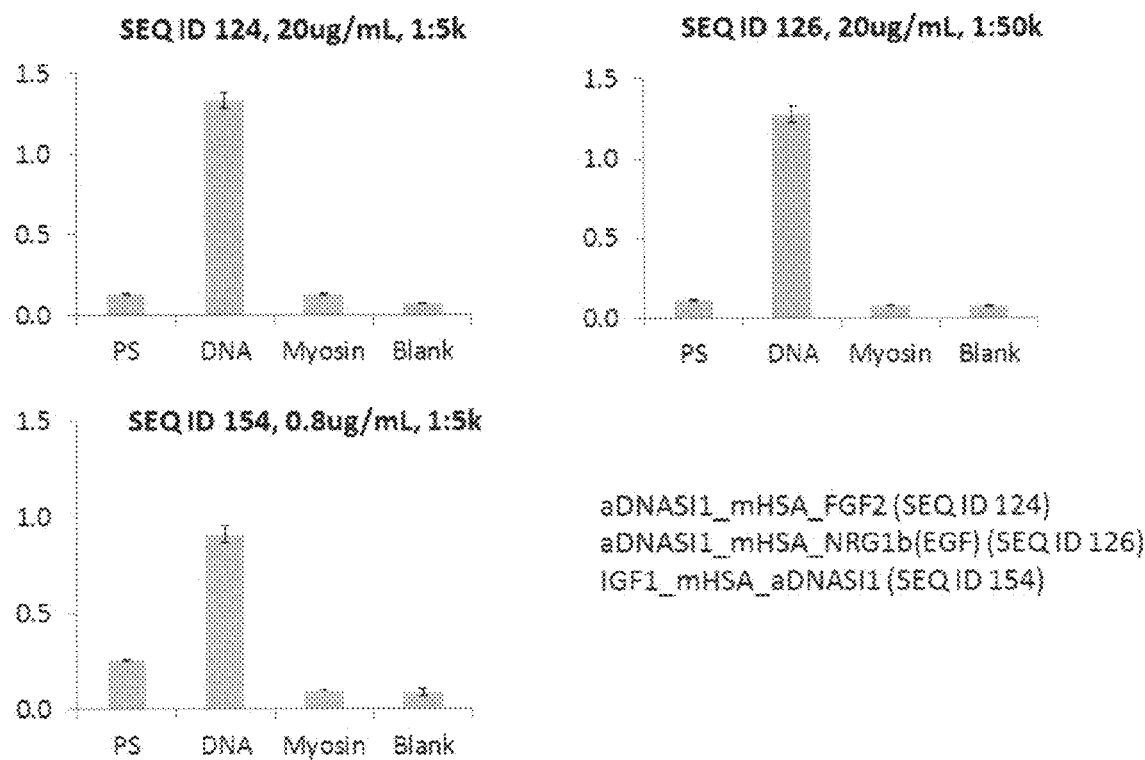
FIG. 20 are graphs showing the specific binding of aDNASI1_mHSA_FGF2, aDNASI1_mHSA_NRG1b (EGF), and IGF1_mHSA_aDNASI1 to DNA.

Fusion proteins were produced as detailed in Example 5. IGF1_mHSA_Syt1 (SEQ ID 152) and IGF1_mHSA_AnxV (SEQ ID 136) were shown to specifically bind phosphatidylserine (FIG. 19). aDNASI1_mHSA_FGF2 (SEQ ID 124), aDNASI1_mHSA_NRG1b(EGF) (SEQ ID 126), and IGF1_mHSA_aDNASI1 (SEQ ID 154) were shown to bind specifically to DNA (FIG. 20).

The fusion proteins were shown to bind specifically to the target molecules demonstrating the retention of functional binding after fusing a targeting domain to a half-life modulator and activator domain and also exemplifying the breadth of targeting domains (as well as target) capable of being fused into fusion proteins. Specific targets, such as phosphatidylserine, may be addressed with a variety of binding domains, such as annexin V and synaptotagmin. Conversely, specific protein classes, like the antibody-derived scFvs, of which aDNASI1 is a member, have a large diversity of members which bind a correspondingly large variety of target molecules or epitopes. The successful incorporation of scFvs into fusion proteins is an indication of the potential for the application of antibody-derived targeting in other fusion proteins. The aDNASI1 domain was further shown to be functional in either N- or C-terminal fusion orientation as well as in fusions that contain a variety of activator domains. Taken together, these results establish that fusion proteins targeting may not be restricted to a specific target epitope, a specific class of targeting domain, a specific translational orientation, or a specific activator domain-containing molecule.

Example 8

Modulation of Cell Activity

The bioactivity of the activator domains of purified fusion proteins was demonstrated in vitro by measuring downstream signaling in stimulated cells. The potency of the fusion proteins was compared to that of wild-type, non-fused activator domains. A variety of fusion proteins with different activator domains, different targeting domains, and different fusion orientations were produced and demonstrated to be bioactive. These data demonstrate that fusion proteins can be produced that are bioactive and capable of signaling cellular pathways such as pro-survival or proliferative pathways.

Each fusion protein was tested alongside a positive-control, commercially obtained, non-fused version of its activator domain. Fusion proteins with active targeting domains (e.g., AnxV) as well as non-binding control targeting domains (e.g., AnxVm1234 or DAscFv) were both used, demonstrating that activity of the activator domain was independent of the identity and function of the targeting domain. Cells to be stimulated were grown, serum starved, and then stimulated with the fusion proteins. Proteins were then washed away, and cell activity was measured by ELISA for either phospho-Akt (pAkt) or phospho-Erk (pErk).

A. Stimulation of AKT Activity in Cancer Cells Using NRG1b(EGF) Fusion Proteins

The fusion proteins NRG1b(EGF)_mHSA_AnxV (SEQ ID 142) and AnxV_mHSA_NRG1b(EGF) (SEQ ID 120) were produced as described in Example 5. Wild-type NRG1b (EGF) was obtained from R&D Systems (396-HB/CF). DU145 cells, a human prostate carcinoma, epithelial-like cell, were seeded in 96-well plates (BD/Falcon, 353072) at 25,000 cells/well in complete medium (RPMI-1640 (Invitrogen/Gibco, 11875) containing 10% FBS (Hyclone, SH30071), 2 mM L-glutamine (Invitrogen/Gibco, 25030), and 50 U/mL penicillin+50 ug/mL streptomycin (Invitrogen/Gibco, 15070)) and incubated overnight at 37° C. and 5% CO2. The next day, the media was aspirated, the cells were washed with 0.1 mL/well PBS (without calcium and magnesium, Sigma, D8537), the cells were re-fed with 0.1 mL/well of RPMI-1640+0.5% FBS, and the cells were incubated for 20-24 hr at 37° C. and 5% CO2. The next day, cells were stimulated with diluted fusion proteins or control proteins, adding 25 µL/well to the existing 0.1 mL/well, for 10 min at 37° C. and 5% CO2. Stimulation was stopped by aspirating media from the wells and washing with 0.2 mL/well cold PBS. Cells were lysed in 25 µL/well complete M-PER lysis buffer (Mammalian protein extraction reagent (Pierce/ThermoScientific, 78501), 150 mM NaCl, protease inhibitor cocktail (Roche complete mini, 04 693 124 001), and phosphatase inhibitors (Roche PhosSTOP, 04 906 837 001)), prepared in advance. Plates were sealed, cells were lysed on an orbital shaker for 30 min at 4° C., and lysates were snap frozen on dry ice and stored at −78° C. 384-well flat, white plates (MaxiSorp, Nunc, 460372) were coated with anti-Akt capture antibody (clone SKB1, Millipore, 05-591), sealed, and stored at room temp overnight.

The next day, the cell lysates were thawed and ELISA plates were washed & blocked. Thawed lysates were pooled, ELISA plates were washed again, Akt standards or pooled lysates were added to the ELISA plates, and plates were incubated for 2 hr at room temp. ELISA plates were washed, anti-phospho Akt detection antibody (biotinylated mouse mAb, Cell Signaling, 5102) was added, and plates were incubated for 1.5 hr at room temp. The plates were washed, streptavidin-horseradish peroxidase (SA-HRP, R&D Systems, 890803) was added, and plates were incubated for 30 min at room temp. Plates were washed again, substrate (SuperSignal ELISA Pico Chemiluminescent, Pierce/ThermoScientific, 37069) was added, and luminescence was read on a plate reader. The pAkt standard curve was fit to a line (log-log scale).

Figure 21:
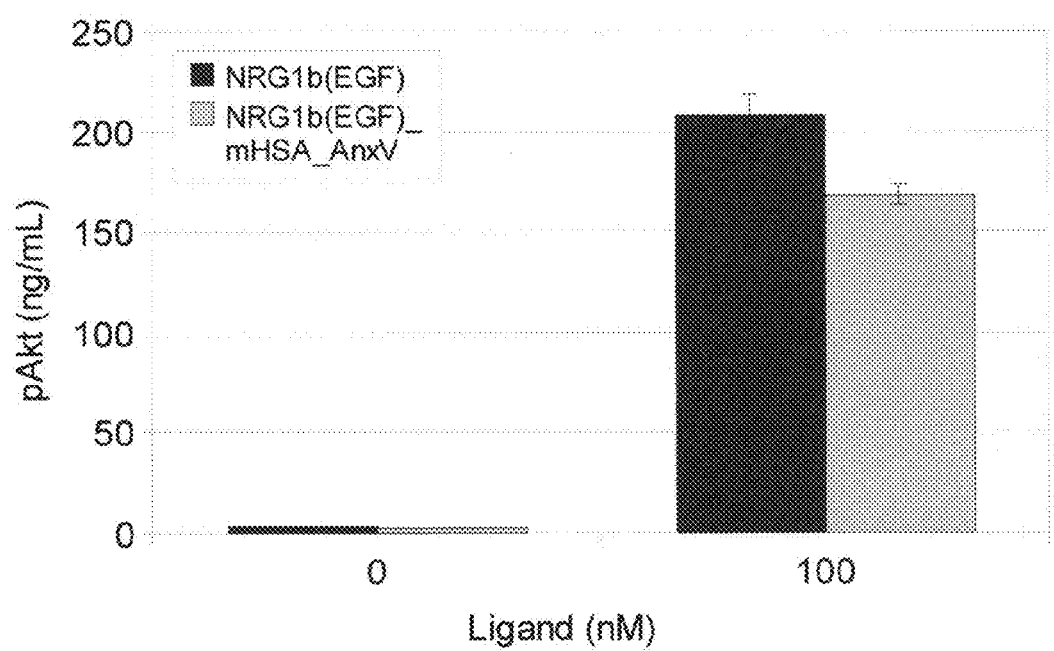
FIG. 21 is a graph showing stimulation of pAkt in DU145 cells by fusion protein, NRG1b(EGF)_mHSA_AnxV, and positive-control, NRG1b(EGF).
Figure 22:
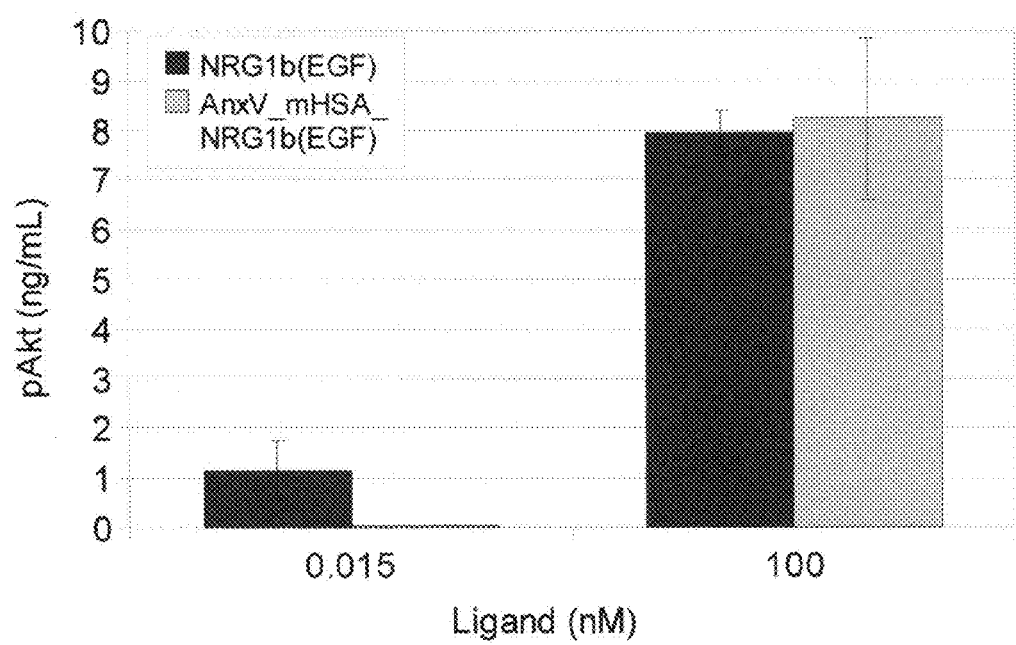
FIG. 22 is a graph showing stimulation of pAkt in DU145 cells by fusion protein, AnxV_mHSA_NRG1b(EGF), and positive-control, NRG1b(EGF).

Activities of NRG1b(EGF) and NRG1b(EGF)_mHSA_AnxV are shown in FIG. 21. Both the commercial wild-type NRG1b(EGF) and the fusion protein were shown to be bioactive, stimulating the pAkt pathway. Similarly, FIG. 22 shows the activities of the wild type and the reverse-orientation fusion protein, AnxV_mHSA_NRG1b(EGF). These results demonstrate that translationally fusing the NRG1b (EGF) activator domain to mHSA and AnxV did not abolish its bioactivity, as the NRG1b(EGF) fusions proteins expressed and purified in Example 5 were bioactive.

B. Stimulation of AKT Activity in Cancer Cells Using IGF1 Fusion Proteins

Figure 23:
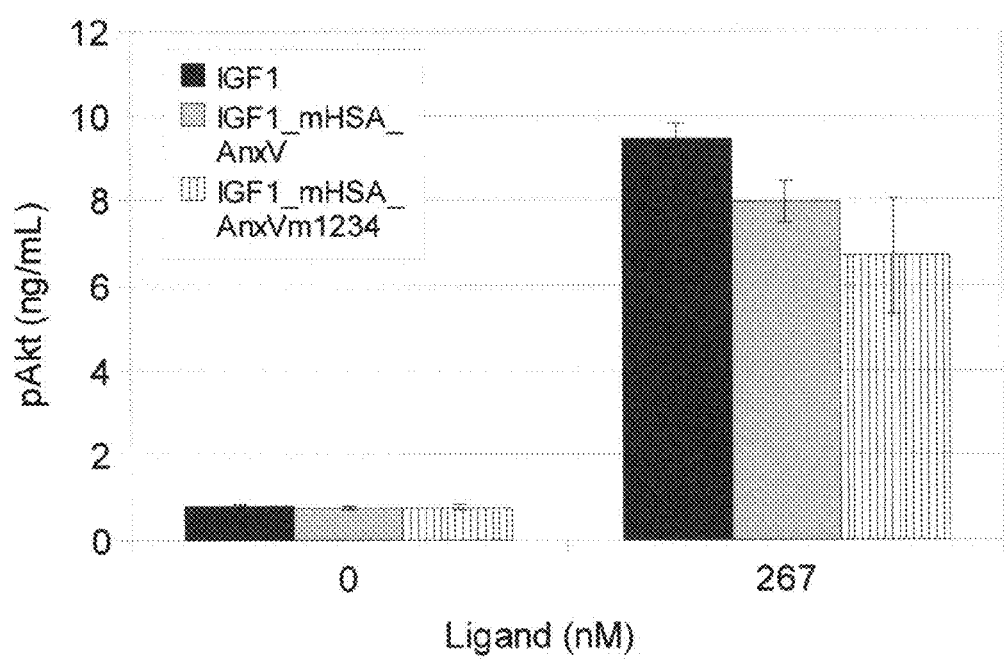
FIG. 23 is a graph showing stimulation of pAkt in DU145 cells by fusion protein IGF1_mHSA_AnxV, fusion protein IGF1_mHSA_AnxVm1234, and positive-control, IGF1.
Figure 24:
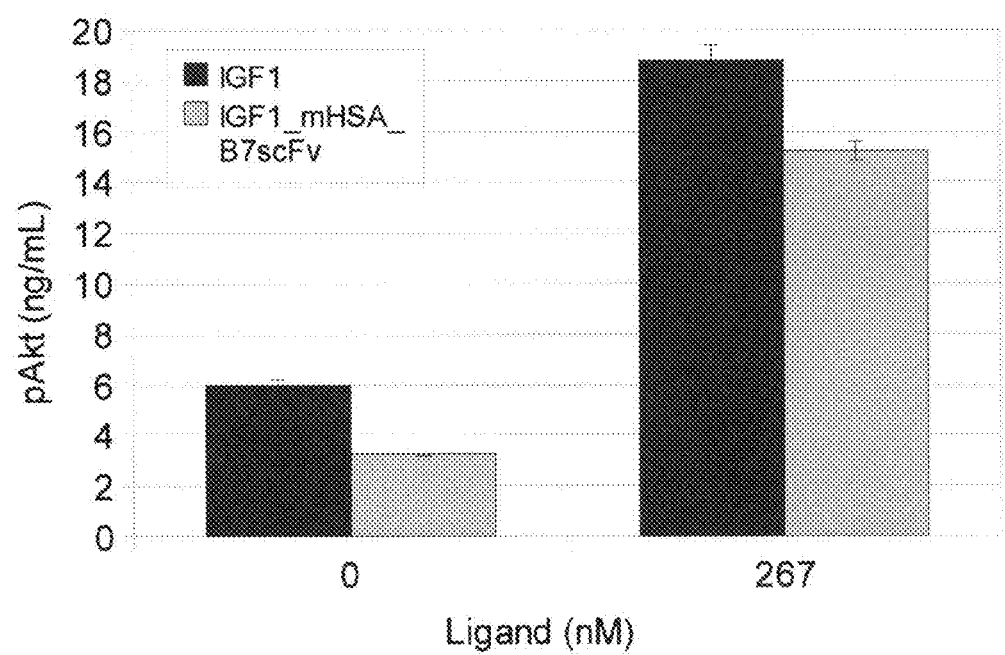
FIG. 24 is a graph showing stimulation of pAkt in DU145 cells by fusion protein IGF1_mHSA_B7scFv, and positive-control, IGF1.

The fusion proteins IGF1_mHSA_AnxV (SEQ ID 136), IGF1_mHSA_AnxVm1234 (SEQ ID 138), and IGF1_mHSA_B7scFv (SEQ ID 150) were produced as described in Example 5. Wild-type IGF1 was obtained from Calbiochem (407240). DU145 cells were grown and stimulated as described in Example 8A. All three IGF1-based protein fusions were shown to be bioactive in the DU145 cancer cells, with similar pAkt stimulation as for wild-type IGF1 (see FIGS. 23-24).

C. Stimulation of AKT Activity in Heart Cells Using IGF1 Fusion Proteins

The fusion protein IGF1_mHSA_AnxV (SEQ ID 136) was produced as described in Example 5. Wild-type IGF1 was obtained from Calbiochem (407240). HL-1 cells (William C. Claycomb, Louisiana State University Health Sciences Center), a cardiac muscle cell line with characteristics of adult cardiomyocytes, were seeded in gelatin/fibronectin pre-coated 96-well plates (BD/Falcon, 353072) at 60,000 cells/well in complete medium (Claycomb medium (Sigma, 51800C), containing 10% FBS (Sigma, 12103C), 2 mM L-glutamine (Invitrogen/Gibco, 25030), 100 U/mL penicillin+100 ug/mL streptomycin (Invitrogen/Gibco, 15070), and 0.1 mM norepinephrine (Sigma, A0937)) and incubated overnight at 37° C. and 5% CO2. Cells were washed and subjected to an ELISA protocol as described in Example 8A.

Figure 25:
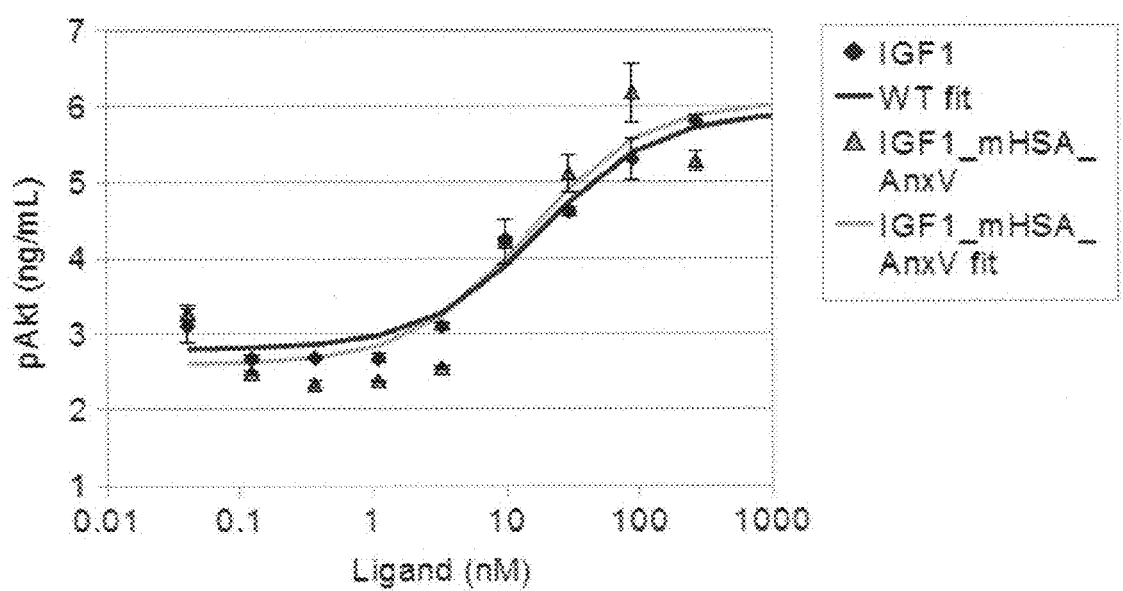
FIG. 25 is a graph showing the dose-response stimulation of pAkt in heart cells by IGF1 and IGF1_mHSA_AnxV.

The IGF1_mHSA_AnxV fusion protein was shown to be bioactive in heart cells, and its potency comparable to wild-type IGF1 (see dose response activities, FIG. 25). These data demonstrate that an activator domain fused to a half-life modulator and a targeting domain can be produced and can retain its ability to potently stimulate cells.

D. FGF2 Fusion Protein Stimulates ERK Activity in Heart Cells

Cardiomyocytes derived from embryonic stem cells (ESCs, provided by Peter Zandstra's lab at the University of Toronto) were dissociated and seeded in gelatin pre-coated 96-well plates at 40,000 cells/well in StemPro-34 medium (Invitrogen/Gibco, 10639) supplemented with 38.5× StemPro-34 nutrient supplement (provided with StemPro-34 medium), 2 mM L-glutamine (Invitrogen/Gibco, 25030), 50

Figure 26:
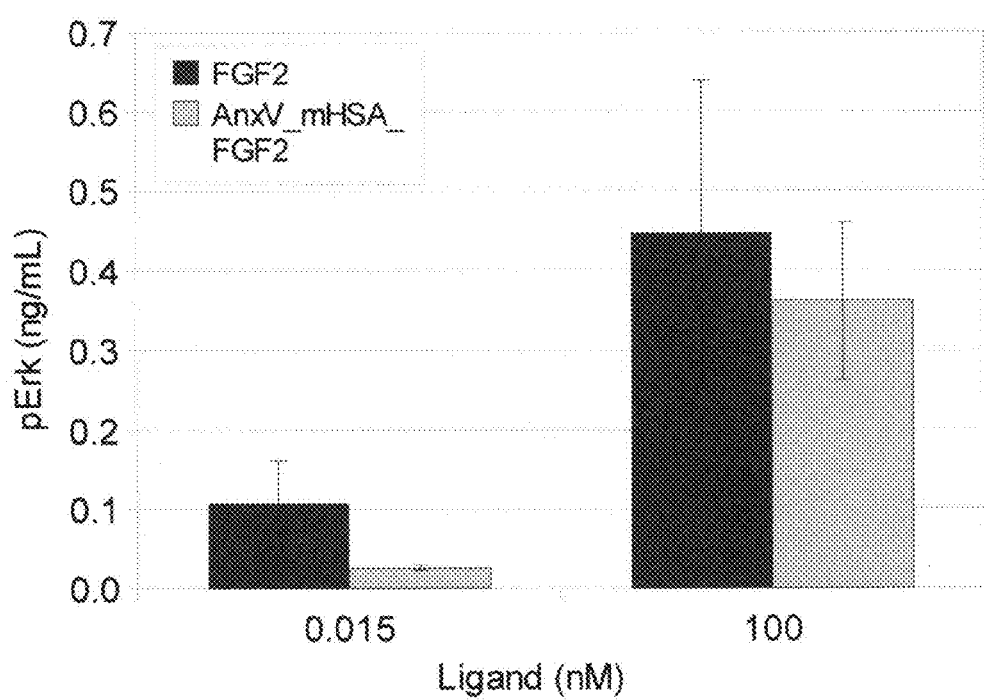
FIG. 26 is a graph showing stimulation of pErk in ESC-derived cardiomyocytes by FGF2 and AnxV_mHSA_FGF2

U/mL penicillin+50 ug/mL streptomycin (Invitrogen/Gibco, 15070), 0.4 mM monothioglycerol (Sigma, M6145), 50 ug/mL ascorbic acid (Sigma, A4544), 150 ug/mL transferrin (Sigma T8158), 10 ng/mL VEGF (R&D Systems, 293-VE), 150 ng/mL DKK-1 (R&D Systems, 5439-DK), and 5 ng/mL basic FGF (FGF2, PeproTech, 100-18b), and incubated at 37° C. and 5% CO2. Twenty-four hours prior to stimulation, the growth medium was changed to StemPro-34 without nutrient supplement and growth factors. Cells were stimulated and lysed as described in Example 8A. For the ELISA, a 96-well high binding black ELISA plate was coated with phospho-Erk1/Erk2 capture antibody (R&D Systems, DYC1018), sealed, and stored overnight at room temperature. The next day, lysates were subjected to the ELISA protocol described in Example 8A, except that instead of Akt standards and an anti-phospho-Akt detection antibody, phospho-Erk1/Erk2 standards (R&D Systems, DYC1018) and a phospho-Erk1/Erk2 detection antibody (R&D Systems, DYC1018) were used to measure activated Erk1/Erk2 levels. The fusion protein AnxV_mHSA_FGF2 (SEQ ID 118) was compared to wild-type FGF2 for stimulation of pERK ESC-derived cardiac cells and was shown to be bioactive (FIG. 26).

Example 9

Accumulation of Fusion Proteins Accumulate with Apoptotic Cells and Stimulation of Cell Activity The ability of fusion proteins to specifically bind to cells via their targeting domain and subsequently stimulate cell signaling pathways via their activator domain was demonstrated in vitro. The targeting domain used was human annexin V (AnxV, SEQ ID 31). AnnV can bind to phosphatidylserine which becomes exposed on the outer cell surface during apoptosis. The activator domain used was IGF1 (SEQ ID 3), which binds to the IGF1 receptor expressed on the cell surface. Once bound, the IGF1 receptor initiates intracellular signaling. Fusion proteins were first bound to apoptotic cardiac cells, which mimic the damaged state of cells in vivo after myocardial infarction. The fusion protein-bound cells were then used to stimulate IGF1 signaling in healthy cardiac cells, mimicking the paracrine effect of the fusion proteins to activate signaling in nearby damaged or healthy cells at or near the infarct zone. Phospho-Akt, a downstream target of IGF1 signaling, was measured by ELISA. Cell-bound fusion protein was able to stimulate Akt signaling in heart cells. Wild type, non-fused IGF1 did not induce Akt signaling indicating that the annexin V targeting domain of the fusion protein was critical for signaling to occur. Likewise, the AnxV_mHSA fusion protein did not stimulate Akt signaling, indicating that the targeting domain itself was not sufficient for signaling. Collectively, these data show that fusion proteins are bi-functional, being capable of specifically target damaged tissue and capable of signaling cellular pathways in a paracrine-like fashion via their activator domains. The results demonstrate a therapeutic role for fusion proteins to accumulate specifically in damaged tissue and not in healthy tissue, to then modulate survival or regeneration through the activator domains.

In a first step, the fusion protein was allowed to accumulate with damaged cells through annexin V-phosphatidylserine binding in HL1 cardiomyocytes undergoing apoptosis. Apoptotic cell death was induced by oxidative stress from treatment with hydrogen peroxide (H2O2). Binding of the fusion protein to damaged cells was carried out by incubating the fusion protein with detached apoptotic cells contained in the growth medium of H2O2 treated cells. In a second step, the bioactivity of the activator domain of cell-bound fusion protein was assessed in vitro by stimulating serum-starved cardiomyocytes with the cell-bound fusion protein. After washing to stop the stimulation, downstream signaling in stimulated cells was measured by ELISA for phospho-Akt (pAkt). The levels of pAkt induced by the fusion protein were compared to that of a commercially obtained, non-fused version of its activator domain as well as that of a fusion protein that contained the annexin V targeting domain but lacked the activator domain.

The fusion protein IGF1_mHSA_AnxV (SEQ ID 136) was expressed and purified as described in Example 5. HL-1 cells (William C. Claycomb, Louisiana State University Health Sciences Center), a cardiac muscle cell line with characteristics of adult cardiomyocytes, were seeded in gelatin/fibronectin pre-coated 96-well plates (BD/Falcon, 353072) at 1:2 in complete medium (Claycomb medium (Sigma, 51800C), containing 10% FBS (Sigma, 12103C), 2 mM L-glutamine (Invitrogen/Gibco, 25030), 100 U/mL penicillin+100 µg/mL streptomycin (Invitrogen/Gibco, 15070), and 0.1 mM norepinephrine (Sigma, A0937)) and incubated at 37° C. and 5% CO2. The following day, the cells were re-fed with 0.1 mL/well of medium supplemented with 400 uM H2O2 (Sigma, H1009), and incubated for 15 min at 37° C. and 5% CO2. Next, the H2O2-supplemented medium was aspirated from each well and replaced with complete medium and the cells were incubated for 20-24 hr at 37° C. and 5% CO2. The next day, medium from the wells was transferred into a 96-deepwell v-bottom plate (USA Scientific, 1896-1110) to collect detached cells. For each sample, medium from 3 wells were pooled into 1 well of the 96-deepwell v-bottom plate. Collected cells were then incubated with fusion proteins in the presence of calcium (binding buffer, a component of Annexin V-FITC apoptosis detection kit, BD Biosciences, 556547) for 15 minutes at 37° C. and 5% CO2. Fusion protein-bound cells were pelleted by centrifugation and washed once with PBS (Sigma, D8537), after which, cells were resuspended in 100 µL/well DMEM containing calcium (binding buffer). HL-1 cells that were seeded in gelatin/fibronectin pre-coated 96-well plates and serum starved in advance were then stimulated with the 100 µL/well resuspended fusion protein-bound cells for 20 minutes. Stimulated cells were then washed and subjected to an ELISA protocol as described in Example 5. Healthy HL-1 cells that were not exposed to H2O2 were also harvested by trypsinization using 40 uL/well of 0.025% Trypsin-EDTA and placed in a 37° C. incubator. Cell detachment was monitored under a microscope and 100 µL/well of DMEM plus 10% FBS was added to deactivate the trypsin. For each sample, trypsinized cells from 3 wells were pooled into 1 well of the 96-deepwell v-bottom plate. Cells were washed with cold PBS, and resuspended in 300 µL of DMEM. Cells were then incubated with fusion proteins in the presence of calcium, processed as described above, and used to stimulate HL-1 cells that were seeded and serum starved in advance. Stimulated cells were washed and subjected to an ELISA protocol as described in Example 8A.

Figure 27:
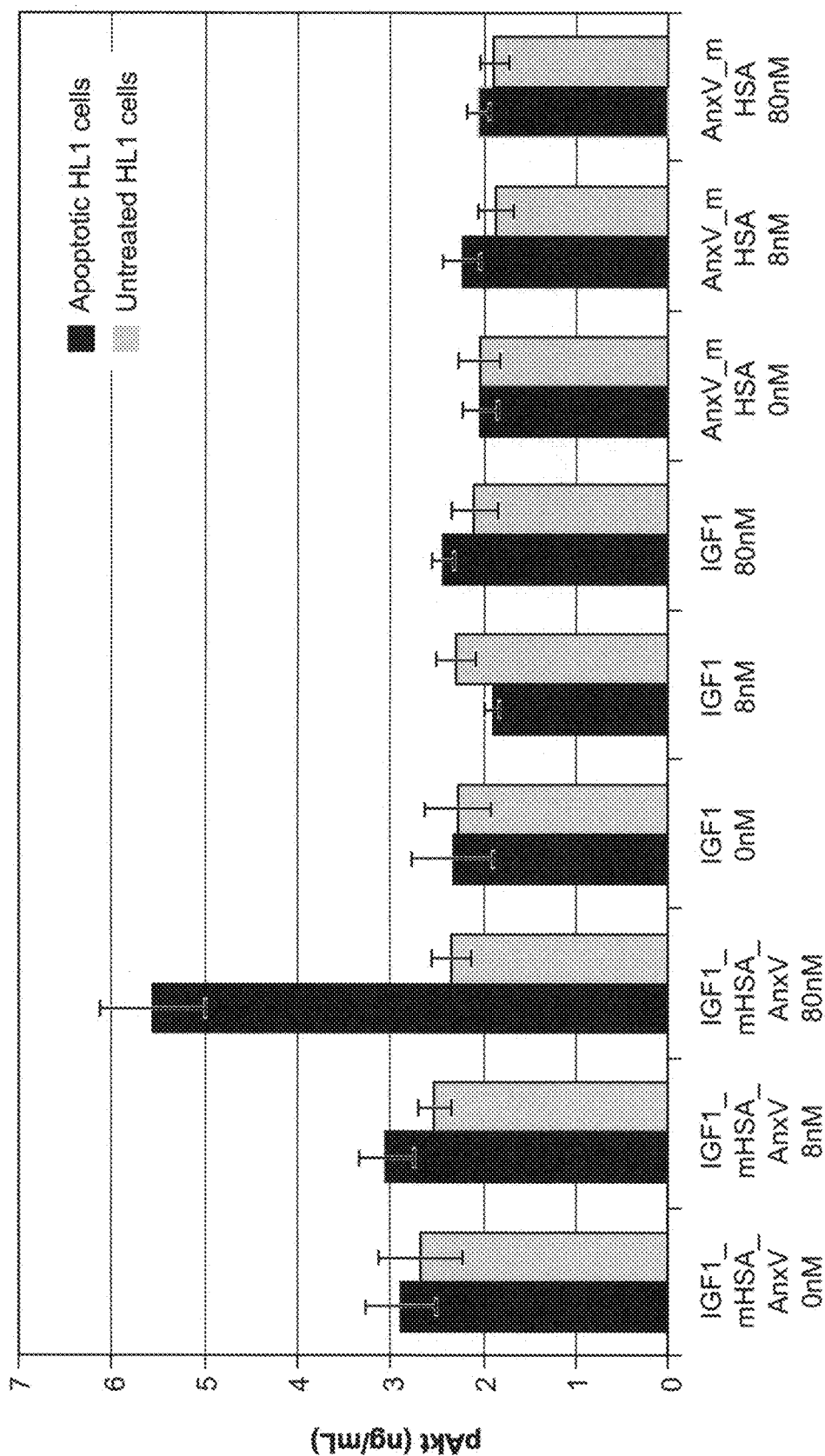
FIG. 27 is a graph showing the pAkt levels induced by proteins pre-mixed with apoptotic HL-1 cells (black bars), and with untreated HL-1 cells (gray bars).

An increase in phospho-Akt levels was observed only in cells stimulated by apoptotically captured fusion protein containing both targeting (AnxV) and activator (IGF1) domains as shown in FIG. 27. Wild type, non-fused IGF1 was unable to stimulate cells, presumably because IGF1 did not bind apoptotic cells and therefore was not captured. Both fusion protein and wild type IGF1 have comparable activities as shown in Example 4C, thus the increase in phospho-Akt levels by captured fusion protein was not caused by differences in their potencies. Although non-fused IGF1 could in theory bind to the IGF1 receptor expressed on the surface of apoptotic cells, there appeared to not be enough growth factor retained to induce signaling, or the growth factor was retained in a signaling-incapable way. Likewise, the AnxV_mHSA fusion protein was unable to stimulate cells. While it was capable of binding apoptotic cells, as shown in Example 6, the AnxV_mHSA fusion protein was not able to signal in a paracrine-like fashion since it lacked the activator domain. Increases in phospho-Akt levels were not detected in cells stimulated by any of the proteins that were premixed with untreated cells, presumably because healthy cells do not have phosphatidylserine exposed on the cell surface for capture of the fusion proteins. Likewise, despite being able to bind IGF1 receptors on the cell surface of healthy cells, the capture of growth factor was not sufficient to stimulate cells. Taken together, the data demonstrate the simultaneous targeting and activating functions of the fusion protein.

Example 10

In Vivo Targeting of Fusion Protein to Damaged Heart Tissue

We tested the hypothesis that the fusion protein IGF1_mHSA_AnxV (SEQ ID: 136), which binds specifically through the AnxV targeting domain to phosphatidylserine on apoptotic and necrotic cells (Example 6), would accumulate more and for longer in damaged heart tissue following myocardial infarction than IGF1_mHSA_AnxVm1234 (SEQ ID: 138)(a variant that does not bind phosphatidylserine). An experimental myocardial infarction (MI) was induced in mice, a test article was injected intravenously (either IGF1_mHSA_AnxV, IGF1_mHSA_AnxVm1234, or vehicle-only control), animals were sacrificed 12, 24, or 72 hours later, and protein accumulation in the infarcted, border zone, and remote (undamaged) areas of the heart was observed by ELISA and immunohistochemistry. The immunohistochemistry demonstrated that IGF1_mHSA_AnxV at 24 hours post-administration is localized in the border zone at the edge of the infarct, while none of the non-binding variant is seen in the infarct, border zone, or remote (healthy) region. The ELISA data demonstrated that the targeted protein, IGF1_mHSA_AnxV, accumulates to a greater extent and for a longer time in the infarcted and border zones of the heart than the non-binding variant protein IGF1_mHSA_AnxVm1234. These data demonstrate the capability of IGF1_mHSA_AnxV, a prototypical targeted fusion protein, to specifically accumulate and persist in damaged heart tissue following myocardial infarction, enabling the specific delivery of fused activators domains.

Experimental myocardial infarction (MI) was induced in mice by ligation of the left coronary artery as explained below in detail. After 60 minutes, the ligation was removed, allowing reperfusion of the heart. Dosing of test articles or vehicle control was done at 22 hours post-MI by injection in the tail vein. 15 mice per group were dosed with the following:
Group 1: Vehicle-only control
Group 2: 15 µg IGF1_mHSA_AnxV
Group 3: 15 µg IGF1_mHSA_AnxVm1234
For each group, 5 mice were sacrificed at each of the following times: 12, 24, and 72 hours post-dosing. For each group/time point, 3 animals were prepared for immunohistochemistry and 2 for ELISA, with the goal of identifying anti-HSA signal specific to IGF1_mHSA_AnxV or IGF1_mHSA_AnxVm1234 in or bordering the infarcted area of the heart. Detailed protocols follow.

The animal work was performed by Biotrofix, Inc., in laboratory space leased at ViviSource Inc., Waltham Mass. The protocol was reviewed and approved by the ViviSource IACUC, and all animal welfare concerns were addressed and documented. Ninety (90) male C57/B6 12-week-old mice were ordered 7-10 days prior to study (including 15 for pilot studies, Charles River Laboratories). They were allowed free access to food and water. Animals were assigned identification numbers using permanent marker on the tail. The animals were observed the day prior to study, and those appearing to be in poor health were excluded. Animals were housed in rooms provided with filtered air at 21±2° C. and 50%±20% relative humidity. The room was on an automatic timer for a light/dark cycle of 12 hours on and 12 hours off with no twilight. Shepherd's® ¼" premium corn cob was used for bedding and a Bio-Huts™ for Mice (BioSery K3352) or a mouse Runnel™ (BioSery K3322, K3323) was put in each cage. Animals were fed with Lab Diet® 5001 chow. Water was provided ad libitum. The animals were housed 4 to 6 per cage.

On the day of surgery, the mouse was weighed, and anesthesia was induced in a Plexiglas chamber with isoflurane in 100% O2. The mouse was placed on the surgery surface on a self-regulating heating pad. The mouse was secured in place on its dorsum (ventral side up), endotracheally intubated using an appropriate size intracath (22G), and maintained on isoflurane anesthesia at 1.0-2.5% in 100% O2. A surgical level of anesthesia was confirmed by loss of palpebral reflex along with lack of response to toe, heel, and tail pinch.

The thorax (from the lowest aspect of the dorsum to just across to the right side of the sternum) was shaved, fur was removed with vacuum, and the skin was prepped with septisol. A skin incision was made over the left thorax from the sternum to the mid-thorax region parallel with the ribs. The intercostal muscles between ribs 5 and 6 were opened over the left side of the heart and the ribs were retracted. The heart (left ventricle and left atrium) was identified, and the pericardium was opened. The left lung was gently compressed inferiorly to remove it from the field. A 7-0 silk suture was placed around the left coronary artery and ligated over a ~2 mm piece of sterile polyethylene PE-10 tubing, and the heart was observed for pallor (blanching, as evidence of ischemia) posterior to the ligation. The residual ends of the suture were cut, and the ligation was removed by cutting through the PE tubing and silk suture after 60 minutes of ischemia time. The wound was kept moist by covering the opening with a sterile warmed saline moistened gauze sponge. Once the suture was removed, the heart was observed for proper reperfusion of the ischemic area. The left lung was re-inflated using PEEP (positive end expiratory pressure), and the opposing ribs were closed with 6-0 non-absorbable monofilament nylon suture. The muscle layers were closed with 6-0 absorbable suture, followed by skin closure with the 6-0 silk suture in continuous fashion.

Buprenorphine (Bedford Labs™ Lot: 18655303) was injected for analgesia (0.05 mg/kg, subcutaneously), the isoflurane was shut off, and the mouse was extubated once spontaneous respiration occurred, and placed in a clean cage with supplemental heat for recovery. Following surgery, animals remained on a heating pad until they recovered from anesthesia. They were then returned to clean cages. They were observed frequently on the day of surgery (Day 0) and at least once daily thereafter. Animals were weighed before surgery on Day −1 and on Day 0 (day of surgery) and then daily until sacrifice.

10 µL aliquots of test articles at the appropriate concentrations (IGF1 Groups 1-3 defined above; vehicle, IGF1_mHSA_AnxV, or IGF1_mHSA_AnxVm1234 in endotoxin-free PBS) were stored at −80° C. until the day of use. Endotoxin-free PBS was stored at 4° C. Each test article aliquot was thawed right before injection. 200 µL of endotoxin-free PBS (room temperature) was added to the test articles and mixed by pipetting up and down several times and then, using a no-headspace syringe, 200 µL was injected into mice through the tail vein, at 22 (+/−1) hours after the MI.

At designated time points (12, 24, or 72 hours following dosing), the mice were euthanized as follows: The animals were placed under deep ketamine/xylazine anesthesia. For 3 animals per treatment group, the chest was opened and the heart was punctured at the apex. About 0.1 ml of 15% KCl was injected to the left ventricle, and the animal was perfusion-fixed by normal saline followed by zinc formalin. The heart was collected, stored in zinc formalin for 24-48 hours, then transferred to 70% Ethyl Alcohol, and stored at 4° C. The samples were then sent to Mass Histology Services for immunohistochemistry measurements.

For 2 animals per treatment group, the animals were perfused with normal saline. The heart was isolated and the left ventricle was washed with saline. The heart was trimmed down to just the left and right ventricles, and dissected into four pieces as shown FIG. 6.1. The pieces were collected, weighed, flash frozen (in liquid Nitrogen), then stored in labeled microcentrifuge tubes (one sample per tube, hence 4 samples per heart) at −80° C. and shipped to Silver Creek Pharmaceuticals on dry ice.

To obtain heart tissue for immunohistochemistry and ELISA control experiments, several additional mice were euthanized as above without surgery, the hearts were excised and rinsed as above, and in some, 2 µg of fusion protein IGF1_mHSA_AnxV in 15 µl was injected directly into the left ventricle wall. Hearts with or without injected protein were fixed as described above in preparation for immunohistochemistry.

Immunohistochemistry Detection of Fusion Proteins

Immunohistochemistry was performed at Mass Histology Service Inc., Worcester, Mass., a GLP-compliant histopathology laboratory. Their standard protocols for processing and staining fixed tissues for detection of specific proteins were used. Briefly, the hearts fixed in zinc-formalin were dissected down to the ventricle and routinely processed through a standard series of alcohols and xylene. Each heart was embedded in paraffin, and sections were made on a Leica microtome at approximately 6 microns in thickness each and placed on microscope slides. For each heart, 8 serial transverse sections were made and placed on slides, 100 µm was skipped, another 8 sections were made, 100 µm was skipped, and this was repeated through the length of the heart.

Two slides from each set of 8 were stained, one with H&E to reveal morphology and the other stained with anti-HSA for HSA-localization, with DAPI counterstaining to show the nuclei of the cells. A traditional process was used for H&E staining. Specifically, the tissue was deparaffinized in xylene, cleared in alcohol, hydrated in water, and stained in Harris hematoxylin. The slide was washed, stained in 1% aqueous eosin, dehydrated in a series of alcohols, cleared in a series of xylenes, and coverslipped. Slides representing sections at various levels of the heart were then viewed with the light microscope to locate sections containing infarcted regions.

For HSA-localization in the heart tissue, sections adjacent to those stained for H&E were washed in xylene, cleared in alcohol, hydrated in water, incubated overnight at 4 C with goat anti-human albumin primary antibody diluted 1:200, and rinsed in PBS. Alexa Fluor 594 donkey anti-goat IgG, the fluorescently labeled antibody against goat anti-HSA antibody, was then used at a dilution of 1:400 for 1 hr at 37 C as the secondary antibody to detect the anti-HSA localization. The slides were rinsed in PBS, and coverslipped using ProLong Gold antifade reagent which also includes a DAPI stain for nuclear visualization.

For positive controls, slides from the hearts directly injected with IGF1_mHSA_AnxV were processed using the anti-HSA protocol as well. In addition, Mass Histology Services stained a sample of human liver tissue, which contains native HSA, as a positive control for the primary detection antibody. Negative controls included directly injected mouse heart that was processed for HSA-localization while leaving out the primary anti-HSA antibody, and a naïve heart (no fusion protein exposure) normally processed for HSA-localization.

ELISA Detection of Fusion Proteins

Figure 28:
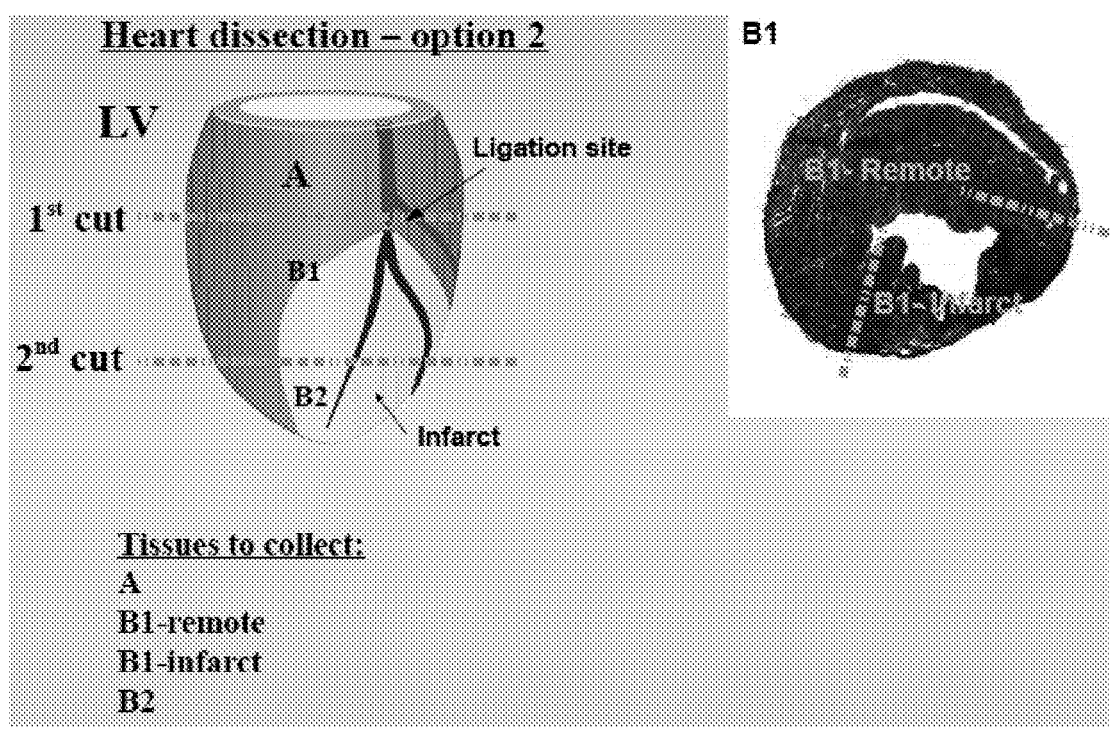
FIG. 28 shows a heart dissection used for preparation of 2 hearts per group for ELISA measurements. Insert in upper right shows a cross section of section B1. Sections B1-infarct and B2 contain most or all of the infarct and nearby border region, while Sections A and B1-remote contain predominantly healthy tissue. LV: Left ventricle.

The four samples per heart (FIG. 28) were prepared for ELISA as follows. Samples were transferred to Eppendorf safe-lock microcentrifuge tubes and were thawed on ice. To each tube, RIPA buffer including Pierce Halt Protease Inhibitor Cocktail (diluted 100-fold into buffer) in a 1:5 ratio of (mg tissue sample):(uL buffer) was added. At least 100 µL buffer was used for each sample. A 50/50 mix of ZROB05 and ZROB10 beads in a 1:2 ratio of beads:buffer were also added. Tubes were placed in a Bullet Blender tissue homogenizer set to speed 9 and homogenized for 3 minutes; this was repeated if homogenization was not complete. The samples were centrifuged and aliquots were taken to perform the BCA (bicinchoninic acid) protein assay to determine total protein in each sample.

Enzyme-Linked Immunosorbent Assay (ELISA) measurements were done using standard methods. Specifically, on day 1, Reacti-Bind plates were coated overnight, 4° C. with 50 µL/well anti-HSA coating antibody diluted 1:50 in Dulbecco's PBS. On day 2, wells were washed 4× with PBS-T (PBS, 0.05% Tween 20) using a plate washer (program 6). Nonspecific binding was blocked with 200 uL/well protein-free blocking buffer for 2 hr at room temperature and wells were washed 4× with PBS-T (PBS, 0.05% Tween 20) using a plate washer. 50 uL/well (96 well plate) of either standard curve sample or test samples were added to the wells. Test samples were diluted in RIPA buffer (+protease inhibitors) to a final total protein concentration of 8.745 mg/mL. Plates were sealed and incubated overnight at 4° C. On day 3, wells were washed 4× with PBS-T using a plate washer and 100 uL/well goat anti-HSA-HRP detection antibody diluted 1:25,000 in PBS-T was added per well and incubated 30 min at room temperature on a shaker platform at 220 rpm, protected from light. Wells were washed 4× with PBS-T using a plate washer. 100 µL per well of 1-step Ultra TMB ELISA reagent at room temperature was added and plates were incubated at room temperature protected from light for 25 minutes. The reaction was stopped with addition of 100 uL KLP TMB stop reagent. Color changes from blue to yellow. After 5 minutes, absorbance readings were made on a plate reader at a wavelength of A450. Background values for absorbance from tissue with no fusion protein exposure were obtained from naïve heart samples produced using the same procedures as above. The background value was subtracted from all test sample absorbance values to obtain the difference. A standard curve for the concentration-absorbance relationship was generated from samples spiked with a range of known amounts of fusion protein. Then the concentration of protein in each test sample was determined by comparison to the standard concentration-absorbance curve. Two aliquots from each heart test sample were measured to assess measurement variability and these are the basis of the standard deviations included in the ELISA data (FIG. 29).

Fusion proteins used include IGF1_mHSA_AnxV (targeted protein) and IGF1_mHSA_AnxVm1234 (non-binding variant), produced as described in Example 5. Vehicle control was endotoxin-free PBS (Sigma). Animals were male C57/B6 mice, 12-week-old when ordered, acclimatized 7-10 days before surgery. Stains and antibodies used in immunohistochemistry: primary antibody was goat anti-human albumin (HSA) cross-adsorbed antibody, affinity purified (Bethyl Labs 080-229A lot #3); fluorescently labeled secondary antibody was Alexa Fluor 594 donkey anti-goat IgG (H+L) (Invitrogen, A11058); ProLong Gold antifade reagent with DAPI (Invitrogen, P36931). Reagents used for ELISA included RIPA Lysis and Extraction Buffer (Pierce, 89901); Pierce Halt Protease Inhibitor Cocktail, EDTA-free (Pierce, 78425); Pierce BCA assay kit, 23227; Reacti-Bind plates (Pierce, 15041); Dulbecco's PBS (Thermo, 28374); protein-free blocking buffer (Pierce, 37572); anti-HSA coating antibody (Bethyl labs antibody A80-229A); goat anti-HSA-HRP detection antibody (Bethyl Labs, A80-229P); 1-step Ultra TMB ELISA reagent (Thermo (Pierce), 34028); KLP TMB stop reagent (KLP, 50-85-05); protein-free blocking buffer (Pierce, 37572); tissue homogenization beads (Next Advance, ZROB05 and ZROB10). Materials used in animal surgery included Buprenorphine (Bedford Labs™ Lot: 18655303), isoflurane, ketamine, xylazine, zinc formalin, and 15% KCl.

Figure 29:
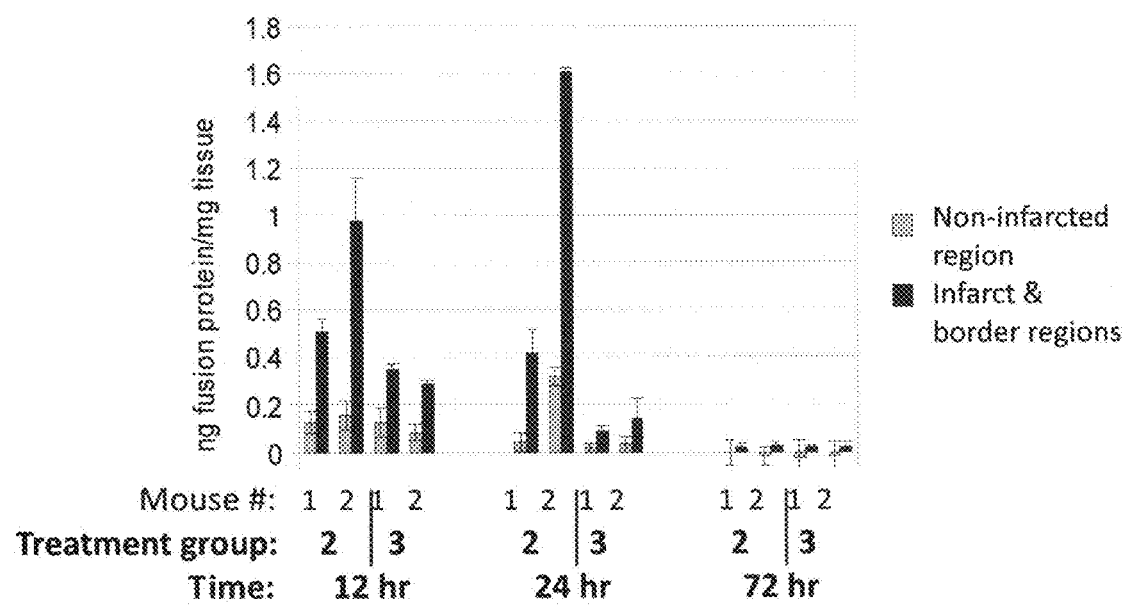
FIG. 29 is a graph showing measurement of IGF1_mHSA_AnxV and non-binding IGF1_mHSA_AnxVm1234 fusion proteins in heart at three times after dosing. Black bars represent the concentration of protein found in the infarcted plus border regions and gray bars represent the concentration of protein found in the noninfarcted regions. Two mice per group are shown. Group 2 corresponds to the mice dosed with targeting protein IGF1_mHSA_AnxV, Group 3 corresponds to the mice dosed with non-binding variant IGF1_mHSA_AnxVm1234.

Detection of targeted and non-binding variant fusion proteins by ELISA are summarized in FIG. 29. Protein measured in the infarct+border zone was compared to protein in the non-infarcted region of the heart in two mice for each of the targeted (Group 2) and non-binding variant (Group 3) fusion proteins at three times after dosing (12, 24, and 72 hours). For each heart, the protein measured in samples A and B1-remote (as defined in FIG. 6-1) were added, and represent the protein in the non-infarcted regions of the heart. Likewise, the protein measured in samples B1-infarct and B2 were added, and represent the protein in the infarcted region plus surrounding border region of the heart.

As shown in FIG. 29, IGF1_mHSA_AnxV, the targeted fusion protein (Group 2, black bars), was highly elevated in the infarct region at both 12- and 24-hours post-injection, compared to its level in the remote regions of heart (Group 2, gray bars) in the same animals. It is undetectable in both infarcted and noninfarcted regions by 72 hours. In comparison, non-binding variant protein IGF1_mHSA_AnxVm1234 (Group 3, black bars) were somewhat elevated at 12 hours, decreasing by 24 hours and undetectable at 72 hours. Comparing the targeted to non-binding protein, at both 12 and 24 hours, the targeted IGF1_mHSA_AnxV was more elevated in the infarct+border zone (black bars, Group 2) than is non-binding IGF1_mHSA_AnxVm1234 (black bars, Group 3). These results demonstrate that the fusion protein IGF1_mHSA_AnxV, which is targeted to the damaged cardiomyocytes (by actively binding phosphatidylserine associated with apoptotic or necrotic cardiomyocytes), can enter and be retained in the areas of the heart damaged by the experimental MI at higher concentrations and for longer times than the non-binding variant. In addition, the data showed specific localization of the targeted fusion protein to the damaged areas of the heart, demonstrating efficacy of targeting via the AnxV targeting domain.

Figure 30:
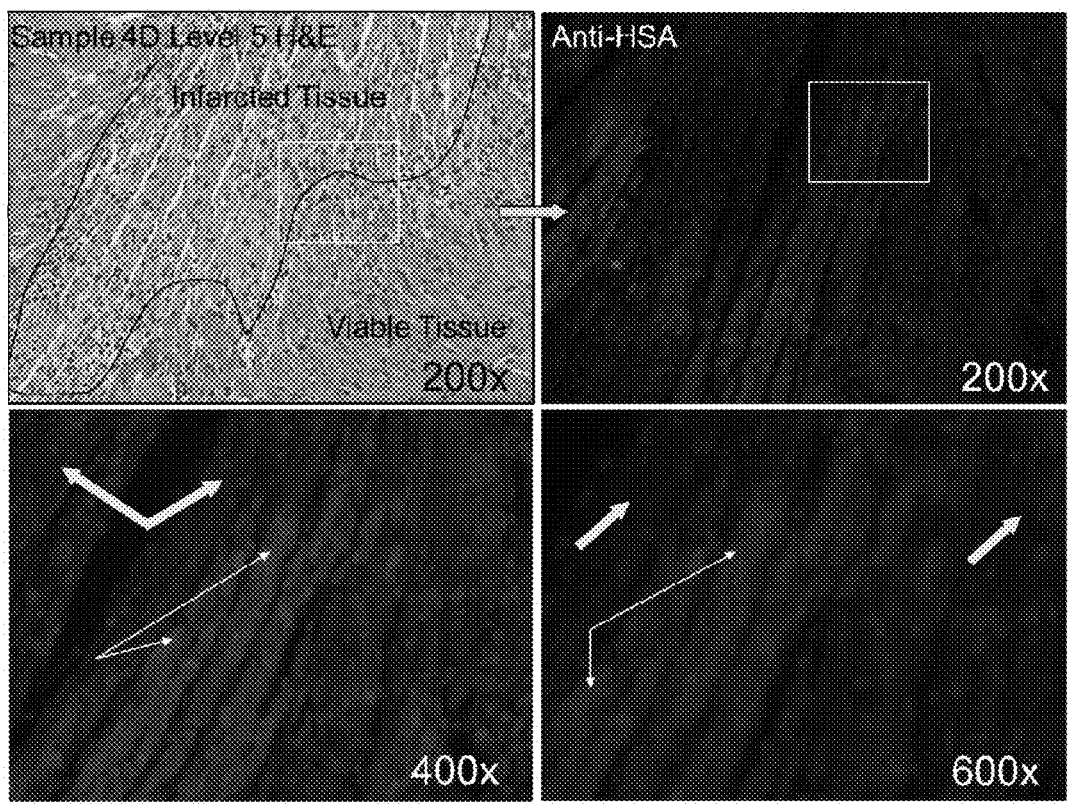
FIG. 30 are representative photomicrographs from immunohistochemical staining of heart sections 24 hr after a mouse was treated with IGF1_mHSA_AnxV.

Localization of HSA-containing fusion proteins by immunohistochemistry also demonstrated greater accumulation of IGF1_mHSA_AnxV in the infarct and bordering region compared to the non-binding variant IGF1_mHSA_AnxVm1234 at 24 hours after dosing. FIG. 30 shows morphology of the infarct and surrounding tissue, as well as positive staining specific for IGF1_mHSA_AnxV at the infarct edge and border region around the infarct. Top left: H&E stain showing morphology. The infarcted region is central, with the edge demarcated by the black curve, and viable is in the upper left and lower right. (200× magnification) Top right: A serial section of this region stained for HSA-containing proteins at the same magnification. Red indicates HSA localization; blue indicates DAPI staining of cell nuclei. Higher magnification images of the same region are shown in the lower left (400×) and lower right (600×). There is positive signal in cardiomyocytes (thin arrows) at the edge of infarcted tissue (medium thickness arrows). White boxes in Top left and right are in approximately in the same place in two adjacent 6 um slides, and the Lower left and right images are magnifications near the area of those boxes.

Figure 31:
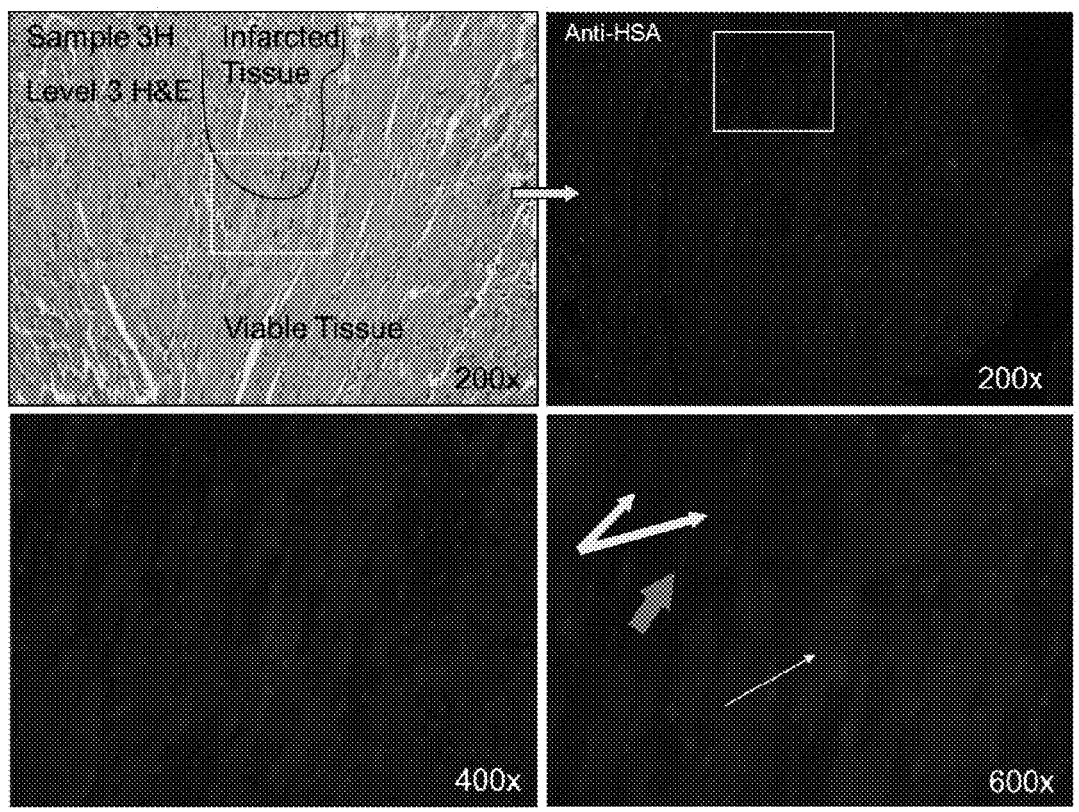
FIG. 31 are representative photomicrographs from immunohistochemical staining of heart sections showing infarcted tissue and bordering areas from a mouse treated with IGF1_mHSA_AnxVm1234. Time point was 24 hours after dosing.

By comparison, FIG. 31 shows the same information for the non-binding mutant IGF1_mHSA_AnxVm1234 showing minimal staining specific for it. Top left: H&E stain showing morphology. The infarcted region is in the upper central part of the image, with the edge demarcated by the black curve (200× magnification). Top right: An adjacent section of this region stained for HSA-containing proteins at the same magnification. Red indicates anti-HSA localization; blue indicates DAPI staining of cell nuclei. Higher magnification images of the same region are shown in the lower left (400×) and lower right (600×). There is only background signal in cardiomyocytes (thin arrow) and red blood cells (thick arrow) at the edge of infarcted tissue (medium thickness arrows). White boxes in Top left and right are in approximately in the same place in two adjacent 6 um slides, and the Lower left and right images are magnifications near the area of those boxes.

Figure 32:
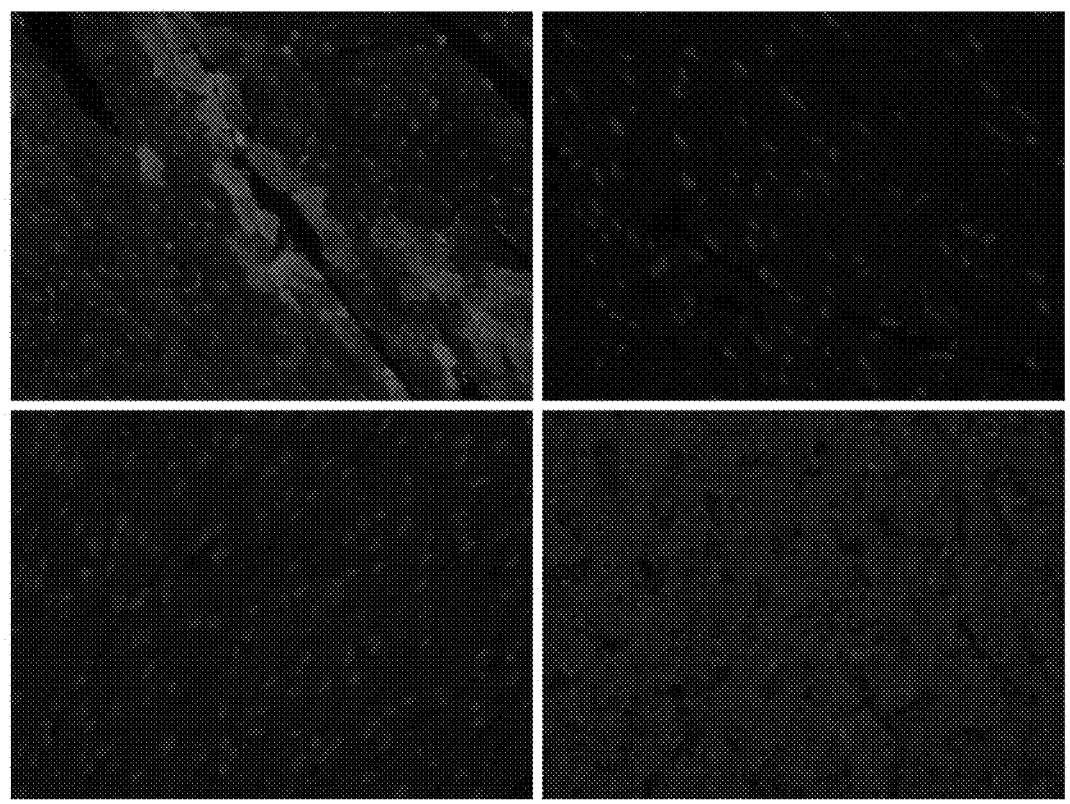
FIG. 32 are photomicrographs of controls used to demonstrate specificity of staining of HSA-containing protein or HSA-producing tissue by the primary anti-HSA antibody used in mouse experiments.

FIG. 32 illustrates the controls used to confirm specificity of the anti-HSA antibody for the HSA-containing fusion proteins. Top left: Positive control in a mouse heart in which IF1_mHSA_AnxV had been directly injected as described. Dark red indicates strong localization of HSA-containing fusion protein where it was injected. Top right: Negative control in mouse heart. Same preparation as in Top left including injection of IGF1_mHSA_AnxV but staining proceeded without the primary anti-HSA antibody. No specific staining seen. Bottom left: Second negative control in mouse heart. No protein was injected in the heart, and it was processed as in the top left. Only faint red background staining can be seen. Bottom right: Positive control in human liver. Human liver produces significant amounts of HSA. Staining with the anti-HSA antibody shows specific staining throughout the sample. In all images: Blue staining is DAPI stain indicating cell nuclei.

It is understood that the examples and embodiments described herein are for illustrative purposes only and that various modifications of changes in light thereof are to be included within the spirit and purview of this application and scope of the appended claims. All publication, patents and patent applications cited herein are hereby incorporated by reference in their entirety for all purposes.

SEQUENCE LISTING (277 sequences)

SEQ ID NO: 1 - protein, 249 aa, Artificial Sequence
  Synthetic construct
LESGGGLVQPGGSLRLSCAGSGFTFSSYAMSWVRQAPGKGLEWVSSISGSGGSTYYADSVKGRFTISRDNSKKTLYLQMNSLRAEDTAVYYCARKRGRTTVSWGLVYFDYWGQGTVVTVSSGGGGSGGGGSGGGGSGGGGSGGSELTQSPGTLSLSPGERATLSCRASHSVSRAYLAWYQQKPGQAPRLLIYGTSSRATGIPDRFSGSGSGTDFTLTISRLEPEDFAVYYCQQYGGSPWFGQGTKVELK

SEQ ID NO: 2 - protein, 251 aa, Artificial Sequence
  Synthetic construct
LEQSGGGVVQPGGSLRLSCTASGFTFSSYGMHWVRQAPGKGLEWVTFIRYDGSSKYSADSVKGRFTISRDNSKNTLFLQMNSLRAEDTAVYYCARARWRDYYYYMDVWGKGTTVTVSSGGGGSGGGGSGGGGSGGGGSGGSELTQEPSVSGAPGQRVTISCTGSSSNIGAGYDVHWYQQLPGTAPKLLIYGNSNRPSGVPDRFSGSKSGTSASLAITGLQAEDEADYYCQSYDSSLSGVVFGGGTKLTVLG

SEQ ID NO: 3 - protein, 70 aa, Homo sapiens
GPETLCGAELVDALQFVCGDRGFYFNKPTGYGSSSRRAPQTGIVDECCFRSCDLRRLEMYCAPLKPAKSA

SEQ ID NO: 4 - protein, 70 aa, Artificial Sequence
  Synthetic construct
GPETLCGAELVAALQFVCGDRGFYFNKPTGYGSSSRRAPQTGIVDECCFRSCDLRRLEMYCAPLKPAKSA

SEQ ID NO: 5 - protein, 70 aa, Artificial Sequence
  Synthetic construct
GPETLCGAALVDALQFVCGDRGFYFNKPTGYGSSSRRAPQTGIVDECCFRSCDLRRLEMYCAPLKPAKSA

SEQ ID NO: 6 - protein, 179 aa, Artificial Sequence
  Synthetic construct
QRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVE

SEQ ID NO: 7 - protein, 88 aa, Artificial Sequence
  Synthetic construct
DYIRNCIIGKGRSYKGTVSITKSGIKCQPWSSMIPHEHSFLPSSYRGKDLQENYCRNPRGEEGGPWCFTSNPEVRYEVCDIPQCSEVE

SEQ ID NO: 8 - protein, 193 aa, Artificial Sequence
  HGF alpha chain N-K2 fusion
QRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNSEVECMTCNGESYRGLMDHTESGKICQRWDHQTPHRHKFLPERYPDKGFDDNYCRNPDGQPRPWCYTLDPHTRWEYCAIKTCADNTMDTDVPLETTE

SEQ ID NO: 9 - protein, 97 aa, Artificial Sequence
  Synthetic construct
SEVECMTCNGESYRGLMDHTESGKICQRWDHQTPHRHKFLPERYPDKGFDDNYCRNPDGQPRPWCYTLDPHTRWEYCAIKTCADNTMDTDVPLETTE

SEQ ID NO: 10 - protein, 585 aa, Artificial Sequence
  Synthetic construct
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGL

SEQ ID NO: 11 - DNA, 1755 bp, Artificial Sequence
  Synthetic construct
gacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctg

SEQ ID NO: 12 - protein, 585 aa, Homo sapiens [sequence omitted]

SEQ ID NO: 13 - DNA, 1755 bp, Homo sapiens
gatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgtagctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaaatgtgccagtctccaaaaatttggagaaagagctttcaaagcatgggcagtggctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaactgtgagctttttaagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcacaaaatgctgcacagagtccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggctta

SEQ ID NO: 14 - protein, 588 aa, Artificial Sequence
  Synthetic construct
AASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGL

SEQ ID NO: 15 - protein, 588 aa, Artificial Sequence
  Synthesized
AAQDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGL

SEQ ID NO: 16 - protein, 589 aa, Artificial Sequence
  Synthetic construct
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAAL

SEQ ID NO: 17 - protein, 592 aa, Artificial Sequence
  Synthetic construct
AASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAAL

SEQ ID NO: 18 - protein, 592 aa, Artificial Sequence
  Synthetic construct
AAQDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAAL

SEQ ID NO: 19 - protein, 588 aa, Artificial Sequence
  Synthetic construct
AASDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 20 - protein, 588 aa, Artificial Sequence
  Synthesized
AAQDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 21 - protein, 589 aa, Artificial Sequence
  Synthetic construct
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLAAAL

SEQ ID NO: 22 - protein, 592 aa, Artificial Sequence
  Synthetic construct
AASDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLAAAL

SEQ ID NO: 23 - protein, 592 aa, Artificial Sequence
  Synthetic construct
AAQDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLAAAL

SEQ ID NO: 24 - protein, 197 aa, Artificial Sequence
  Synthetic construct
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQR

SEQ ID NO: 25 - protein, 197 aa, Artificial Sequence
  Synthetic construct
GKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQ

SEQ ID NO: 26 - protein, 205 aa, Artificial Sequence
  Synthetic construct
VEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGL

SEQ ID NO: 27 - protein, 197 aa, Artificial Sequence
  Synthetic construct
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQR

SEQ ID NO: 28 - protein, 205 aa, Artificial Sequence [sequence omitted]

SEQ ID NO: 29 - protein, 609 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 30 - protein, 245 aa, Artificial Sequence
  Synthetic construct
EVQLQQSGPELVKPGASMKISCKASGYSFTGYTMKWVKQSHGKNLEWIGLINPYNGGTSYNQKFKGKATLTVDKSSSTAYMELLSLTSDDSAVYYCAREGDYDGAMDYWGQGTSVTVSGGGGSGGGGSGGGGSGGGGSGGSDIQMTQSPSSLSASLGGKVTITCKSSQDINKYIAWYQHKPGKGPGLLIHYTSTLQPGIPSRFSGSGSGRDYSFSISNLDPENIAAYYCLQYDNLYTFGGGTRLE

SEQ ID NO: 31 - protein, 319 aa, Homo sapiens
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 32 - protein, 175 aa, Artificial Sequence
  Synthetic construct
QRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQC

SEQ ID NO: 33 - protein, 88 aa, Artificial Sequence; identical to SEQ ID NO: 7
  Synthetic construct

SEQ ID NO: 34 - protein, 193 aa, Artificial Sequence; identical to SEQ ID NO: 8
  Synthetic construct

SEQ ID NO: 35 - protein, 97 aa, Artificial Sequence; identical to SEQ ID NO: 9
  Synthetic construct

SEQ ID NO: 36 - protein, 206 aa, Artificial Sequence
  Synthetic construct
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 37 - protein, 430 aa, Artificial Sequence [sequence omitted]

SEQ ID NO: 38 - protein, 146 aa, Artificial Sequence
  Synthetic construct
PALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 39 - protein, 65 aa, Artificial Sequence
  Synthetic construct
SHLVKCAEKEKTFCVNGGECFMVKDLSNPSRYLCKCQPGFTGARCTENVPMKVQNQEKAEELYQK

SEQ ID NO: 40 - protein, 222 aa, Homo sapiens
SGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQK

SEQ ID NO: 41 - protein, 19 aa, Artificial Sequence
  Synthetic construct
MGWSLILLFLVAVATRVLS

SEQ ID NO: 42 - protein, 21 aa, Artificial Sequence
  Synthetic construct
MAWRLWWLLLLLLLLWPMVWA

SEQ ID NO: 43 - protein, 9 aa, Artificial Sequence
  Synthetic construct
GGSHHHHHH

SEQ ID NO: 44 - protein, 11 aa, Artificial Sequence
  Synthetic construct
GGSGGHHHHHH

SEQ ID NO: 45 - protein, 588 aa, Artificial Sequence
  Synthetic construct
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAA

SEQ ID NO: 46 - protein, 592 aa, Artificial Sequence
  Synthetic construct
GADAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAALQ

SEQ ID NO: 47 - protein, 592 aa, Artificial Sequence
  Synthetid construct
GADAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATG

SEQ ID NO: 48 - protein, 592 aa, Artificial Sequence
  Synthetic construct
ASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAALQ

SEQ ID NO: 49 - protein, 592 aa, Artificial Sequence
  Synthetic construct
ASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATG

SEQ ID NO: 50 - protein, 157 aa, Artificial Sequence
  Synthetic construct
GTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 51 - protein, 463 aa, Artificial Sequence
  Synthetic construct
QRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLR

SEQ ID NO: 52 - protein, 84 aa, Artificial Sequence
  Synthetic construct
DYIRNCIIGKGRSYKGTVSITKSGIKCQPWSSMIPHEHSFLPSSYRGKDLQENYCRNPRGEEGGPWCFTSNPEVRYEVCDIPQC

SEQ ID NO: 53 - protein, 178 aa, Artificial Sequence
  Synthetic construct
QRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNSEVECMTCNGESYRGLMDHTESGKICQRWDHQTPHRHKFLPERYPDKGFDDNYCRNPDGQPRPWCYTLDPHTRWEYCAIKTC

SEQ ID NO: 54 - protein, 82 aa, Artificial Sequence
  Synthetic construct
SEVECMTCNGESYRGLMDHTESGKICQRWDHQTPHRHKFLPERYPDKGFDDNYCRNPDGQPRPWCYTLDPHTRWEYCAIKTC

SEQ ID NO: 55 - protein, 245 aa, Artificial Sequence
  Synthetic constrruct
SERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQK

SEQ ID NO: 56 - protein, 71 aa, Artificial Sequence
  Synthetic construct
TSHLVKCAEKEKTFCVNGGECFMVKDLSNPSRYLCKCPNEFTGDRCQNYVMASFYKHLGIEFMEAEELYQK

SEQ ID NO: 57 - protein, 815 aa, Homo sapiens
NNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYTTKIITKVVEPKIKVIEGSLQPIIKTEGPTLTKVKIEGEPEFRLIKEGETITEVIHGEPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 58 - protein, 648 aa, Artificial Sequence
  Synthetic construct
NNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVY

SEQ ID NO: 59 - protein, 114 aa, Artificial Sequence
  Synthetic construct
QAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 60 - protein, 223 aa, Artificial Sequence
  Synthetic construct
KSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCRGGGSGGGSGGGSGGGKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 61 - protein, 188 aa, Artificial Sequence [sequence omitted]

SEQ ID NO: 62 - protein, 167 aa, Artificial Sequence
  Synthetic construct
PVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDSPRPLCPRCTQHHQRPDPRTCRRRCRRRSFLRCQGRGLELNPDTCRCRKLRR

SEQ ID NO: 63 - protein, 131 aa, Artificial Sequence
  Synthetic construct
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDS

SEQ ID NO: 64 - protein, 110 aa, Artificial Sequence
  Synthetic construct
PVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDS

SEQ ID NO: 65 - protein, 205 aa, Artificial Sequence
  Synthetic construct
GEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 66 - protein, 458 aa, Artificial Sequence
  Synthetic construct
LERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDTLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPKELAKLVNKRSDFASNCCSINSPPLYCDSEIDAELKNIL

SEQ ID NO: 67 - protein, 205 aa, Artificial Sequence
  Synthetic construct
GEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGL

SEQ ID NO: 68 - protein, 591 aa, Artificial Sequence
  Synthetic construct
RTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 69 - protein, 591 aa, Artificial Sequence
  Synthetic construct
RTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVQFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 70 - protein, 107 aa, Artificial Sequence
  Synthetic construct
DIQMTQSPSSLSASVGDRVTITCRASQWIGSQLSWYQQKPGKAPKLLIMWRSSLQSGVPSRFSGSGSGTDFTLTISSLQPEDFATYYCAQGAALPRTFGQGTKVEIK

SEQ ID NO: 71 - protein, 482 aa, Artificial Sequence
  Synthetic construct
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEPKSSDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 72 - protein, 128 aa, Artificial Sequence
  Synthetic construct
EKLGKLQYSLDYDFQNNQLLVGIIQAAELPALDMGGTSDPYVKVFLLPDKKKKFETKVHRKTLNPVFNEQFTFKVPYSELGGKTLVMAVYDFDRFSKHDIIGEFKVPMNTVDFGHVTEEWRDLQSAEK

SEQ ID NO: 73 - protein, 244 aa, Artificial Sequence
  Synthetic construct
LESGGGLVQPGGSLRLSCAGSGFTFSSYAMSWVRQAPGKGLEWVSSISGSGGSTYYADSVKGRFTISRDNSKKTLYLQMNSLRAEDTAVYYCARKRGRTTVSWGLVYFDYWGQGTVVTVSSGGGGSGGGGSGGGGSGGSELTQSPGTLSLSPGERATLSCRASHSVSRAYLAWYQQKPGQAPRLLIYGTSSRATGIPDRFSGSGSGTDFTLTISRLEPEDFAVYYCQQYGGSPWFGQGTKVELK

SEQ ID NO: 74 - protein, 128 aa, Artificial Sequence
  Synthetic construct
EKLGKLQYSLDYDFQNNQLLVGIIQAAELPALDMGGTSNPYVKVFLLPDKKKKFETKVHRKTLNPVFNEQFTFKVPYSELGGKTLVMAVYNFDRFSKHDIIGEFKVPMNTVDFGHVTEEWRDLQSAEK

SEQ ID NO: 75 - protein, 254 aa, Artificial Sequence
  Synthetic construct
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARADVGYCTDRTCAKAPAWLGVWGQGTLVTVSSGGGGSSGGGSGGGGSQSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVL

SEQ ID NO: 76 - protein, 252 aa, Artificial Sequence
  Synthetic construct
EVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKITGAYSSSWYYDNWFDPWGQGTLVTVSSGGGGSGGGGSGGGGSGGSSYELTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVLGQ

SEQ ID NO: 77 - protein, 247 aa, Artificial Sequence
  Synthetic construct
EVQLVESGGGVVQPGGSLRLFCAASGFTFDGYAMHWVRQAPGKGLEWVSLISGDGGSTYYADSVKGRFTISRDNSKNSLYLQMNSLRAEDTALYYCAKGKVTTIYDRFDIWGQGTMVTVSSGGGGSGGGGSGGGGSGGSDIQMTQSPSSLSASVGDRVTITCRASQGISNYLAWYQQKPGKVPKSLIYAASTLQSGVPSRFSGSGSGTDFTLTISSLQPEDVATYYCQKYNSAPRTFGPGTKLEIKR

SEQ ID NO: 78 - protein, 243 aa, Artificial Sequence
  Synthetic construct
EVQLVESGGGLVQPGGSLRLSCAASGFTFSSYSMNWVRQAPGKGLEWVSYISSTIITIYYADSVKGRFTISRDNAKNSLYLQMNSLRAEDTAVYYCARGDSSEAFDIWGQGTMVTVSLGGGGSGGGGSGGGGSGGSSYELTQPSSVSVSPGQTARITCSGDLLAKKYARWFQQKPGQAPILVIFKDTERPSGIPERFSGSSSGTTVTLTISGAQVEDEADYYCYSASDNNGRVFGGGTKLTVL

SEQ ID NO: 79 - protein, 256 aa, Artificial Sequence
  Synthetic construct
EVQLVESGGGLVKPGGSLRLSCAASGFTFSKAWMSWVRQAPGKGLEWVGRIKSKTDGGTTDYAAPVKGRLTISRDSSKNTLYLRMNSLKTEDTAVYYCTTGITMIIVVITTSSKRTSFEYWGQGTLVTVSSGGGGSGGGGSGGGGSGGSDIQMTQSPSSLSASVGDRVTITCRASQSISNYLNWYQQKPGKAPNLLIYAASSLQSGVPSRFSGSGSGTDFTLTISGLQAEDFATYYCQQSYSALTFGPGTKVDIRR

SEQ ID NO: 80 - protein, 229 aa, Artificial Sequence
  Synthetic construct
GLVKPSQTLSLTCAISGDSVSSNSAAWNCIRPVPSRGLEWLGRTTYRSKWYNDYAVSVKSRITINPDTSKNQFSLQLNSVTPEDTAVYYCASTTLNWGYEKDDAFDIWGQGTMVTVSSGGGGSGGGGSGGGGSGGSQAVLTQPASLSASPGASASLTCTLRSGINVCTPRIYWQGSGVPSRFSGSKNASANAGILLISGLQSEDEADYYCMIWHSSALVFGGGTKLTVL

SEQ ID NO: 81 - protein, 319 aa, Artificial Sequence
  Synthetic construct
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLSGEDD

SEQ ID NO: 82 - protein, 319 aa, Artificial Sequence
  Synthetic construct
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 83 - protein, 319 aa, Artificial Sequence
  Synthetic construct
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 84 - protein, 319 aa, Artificial Sequence
  Synthetic construct
AQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDD

SEQ ID NO: 85 - protein, 364 aa, Artificial Sequence
  Synthetic construct
LDICSKNPCHNGGLCEEISQEVRGDVFPSYTCTCLKGYAGNHCETKCVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 86 - protein, 186 aa, Artificial Sequence
  Synthetic construct
AQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 87 - protein, 86 aa, Artificial Sequence
  Synthetic construct
  PEPTIDE (1)..(86)
MMRFPSIFTAVLFAASSALAAPVNTTTEDETAQIPAEAVIGYSDLEGDFDVAVLPFSNSTNNGLLFINTTIASIAAKEEGVSLDKR

SEQ ID NO: 88 - protein, 85 aa, Artificial Sequence
  Synthetic construct
  PEPTIDE (1)..(85)
MRFPSIFTAVLFAASSALAAPANTTTEDETAQIPAEAVIDYSDLEGDFDAAALPLSNSTNNGLSSTNTTIASIAAKEEGVQLDKR

SEQ ID NO: 89 - protein, 18 aa, Artificial Sequence
  Synthetic construct
  PEPTIDE (1)..(18)
MQLLRCFSIFSVIASVLA

SEQ ID NO: 90 - protein, 20 aa, Artificial Sequence
  Synthetic construct
  PEPTIDE (1)..(20)
MMLLQAFLFLLAGFAAKISA

SEQ ID NO: 91 - protein, 38 aa, Artificial Sequence
  Synthetic construct
  PEPTIDE (1)..(38)
MKVLIVLLAIFAALPLALAQPVISTTVGSAAEGSLDKR

SEQ ID NO: 92 - protein, 14 aa, Artificial Sequence
  Synthetic construct
  PEPTIDE (1)..(14)
GGSGGSGGHHHHHH

SEQ ID NO: 93 - protein, 14 aa, Artificial Sequence
  Synthetic construct
  PEPTIDE (1)..(14)
GGSGGCGGHHHHHH

SEQ ID NO: 94 - protein, 14 aa, Artificial Sequence
  Synthetic construct
  PEPTIDE (1)..(14)
GGAGGSGGHHHHHH

SEQ ID NO: 95 - protein, 4 aa, Artificial Sequence
  Synthetic construct
  peptide (1)..(4)
GAAS

SEQ ID NO: 96 - protein, 4 aa, Artificial Sequence
  Synthetic construct
  peptide (1)..(4)
ASAQ

SEQ ID NO: 97 - protein, 12 aa, Artificial Sequence
  Synthetic construct
  PEPTIDE (1)..(12)
GAQGGGSGGSAG

SEQ ID NO: 98 - protein, 15 aa, Artificial Sequence
  Synthetic construct
  PEPTIDE (1)..(15)
GGAGAQGGGSGGSAG

SEQ ID NO: 99 - protein, 5 aa, Artificial Sequence
  Synthetic construct
  PEPTIDE (1)..(5)
AAALQ

SEQ ID NO: 100 - protein, 5 aa, Artificial Sequence
  Synthetic construct
  PEPTIDE (1)..(5)
AAATG

SEQ ID NO: 101 - protein, 6 aa, Artificial Sequence
  Synthetic construct
  PEPTIDE (1)..(6)
AAATGS

SEQ ID NO: 102 - protein, 12 aa, Artificial Sequence
  Synthetic construct
  PEPTIDE (1)..(12)
GSTGGGSGGGTG

SEQ ID NO: 103 - protein, 15 aa, Artificial Sequence
  Sythetic constrict
  PEPTIDE (1)..(15)
GGGGSGGGGSGGGGS

SEQ ID NO: 104 - protein, 20 aa, Artificial Sequence
  Synthetic construct
  PEPTIDE (1)..(19)
GGGGSGGGGSGGGGSGGGGS

SEQ ID NO: 105 - protein, 20 aa, Artificial Sequence
  Synthetic construct
ASPAAPAPASPAAPAPSAPA

SEQ ID NO: 106 - protein, 922 aa, Artificial Sequence
  Synthetic construct
LESGGGLVQPGGSLRLSCAGSGFTFSSYAMSWVRQAPGKGLEWVSSISGSGGSTYYADSVKGRFTISRDNSKKTLYLQMNSLRAEDTAVYYCARKRGRTTVSWGLVYFDYWGQGTVVTVSSGGGGSGGGGSGGGGSGGGGSGGSELTQSPGTLSLSPGERATLSCRASHSVSRAYLAWYQQKPGQAPRLLIYGTSSRATGIPDRFSGSGSGTDFTLTISRLEPEDFAVYYCQQYGGSPWFGQGTKVELKGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAALQGPETLCGAELVDALQFVCGDRGFYFNKPTGYGSSSRRAPQTGIVDECCFRSCDLRRLEMYCAPLKPAKSAGGSHHHHHH

SEQ ID NO: 107 - DNA, 2772 bp, Artificial Sequence
  Synthetic construct
ctggagagcgggggtggcctggtccaaccaggcggatctctgagactcagttgtgcagggagcggatttaccttcagctcctatgctatgtcttgggtgcgccaggcacccgggaaggggctggagtgggtcagtagcatcagtggcagcggcggaagcacctactatgctgatagtgttaagggaaggttcacgatcagccgcgacaattccaaaaagaccctttatctccaaatgaactcactgcgcgccgaagatacggccgtctactactgtgcacggaaaagaggcagaaccaccgtgtcctggggcctggtttacttcgattactggggtcagggcaccgtagtgactgtgagcagcggaggcgggggttctggtggcggaggatcaggcggcggaggaagtggtgggggcggctccggtgggagcgagctgactcagtctccgggaactcttagtttgtctcccggcgagcgagcgacactctcttgccgagcgtcccactccgtgtctcgagcctatctggcctggtatcaacagaaacctgggcaggcaccccggctgctgatttacgggacttcctcacgggctacaggtatccctgacaggttttccggcagtggctccgggacagacttcaccctgactatatcaaggctggaaccagaagactttgccgtgtattactgccagcagtacggagggtcaccttggttcgggcagggaacaaaggtggagcttaagggcgccgcctccgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgaccgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggccgcagctctgcagggcccagaaacactttgtggagccgaactggtggatgctctccaattcgtttgcggcgaccgcggattctactttaacaagcccaccggttacgggtcttcaagccggagggccccgcagactggcatcgtcgacgagtgctgttttagaagctgcgatctgcgacggttggagatgtattgtgcacctctgaagcccgcgaaaagtgctgggggctcccaccatcaccatcaccactagtga

SEQ ID NO: 108 - protein, 918 aa, Artificial Sequence
  Synthetic construct
EVQLQQSGPELVKPGASMKISCKASGYSFTGYTMKWVKQSHGKNLEWIGLINPYNGGTSYNQKFKGKATLTVDKSSSTAYMELLSLTSDDSAVYYCAREGDYDGAMDYWGQGTSVTVSGGGGSGGGGSGGGGSGGGGSGGSDIQMTQSPSSLSASLGGKVTITCKSSQDINKYIAWYQHKPGKGPGLLIHYTSTLQPGIPSRFSGSGSGRDYSFSISNLDPENIAAYYCLQYDNLYTFGGGTRLEGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAALQGPETLCGAELVDALQFVCGDRGFYFNKPTGYGSSSRRAPQTGIVDECCFRSCDLRRLEMYCAPLKPAKSAGGSHHHHHH

SEQ ID NO: 109 - DNA, 2760 bp, Artificial Sequence
  Synthetic construct
gaagtgcagcttcagcagagcgggcctgaactggttaaaccaggtgccagcatgaagatttcctgtaaggcttctgggtacagtttcaccgggtacaccatgaaatgggtgaagcaaagccacggaaagaaccttgagtggattggattgatcaacccctataatgggggaactagctataaccagaagttcaaggggaaggctactctgacggtggacaagtcatcaagcaccgcatatatggagctcctctccctgacttctgacgacagcgcagtatactattgcgccagagagggggactacgatggggctatggactactggggccaggggacaagcgtcactgtctccggtggaggtggctccggtggcggcggaagcggcggtggaggctcagggggcggaggctctggcggctcagacatccagatgacccaatccccgtcttccctctctgcctccttgggcgggaaggtgacaatcacgtgcaaaagttcccaggatatcaataaatacatcgcctggtaccaacacaaaccaggcaaaggccctggactgctgatacattataccagtaccttgcagcccggcataccctctcggttcagcggcagtggatcaggtcgcgattacagttttagtatttcaaatctggatcctgagaatattgcagcgtattactgtctccagtatgataacctgtacacatttggagggggaacaaggctggaaggcgccgcctccgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgaccgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggccgcagctctgcagggcccagaaacactttgtggagccgaactggtggatgctctccaattcgtttgcggcgaccgcggattctactttaacaagcccaccggttacgggtcttcaagccggagggccccgcagactggcatcgtcgacgagtgctgttttagaagctgcgatctgcgacggttggagatgtattgtgcacctctgaagcccgcgaaaagtgctgggggctcccaccatcaccatcaccactagtga

SEQ ID NO: 110 - protein, 1027 aa, Artificial Sequence [sequence omitted]

SEQ ID NO: 111 - DNA, 3087 bp, Artificial Sequence
  Synthetic construct
ctggagagcgggggtggcctggtccaaccaggcggatctctgagactcagttgtgcagggagcggatttaccttcagctcctatgctatgtcttgggtgcgccaggcacccgggaaggggctggagtgggtcagtagcatcagtggcagcggcggaagcacctactatgctgatagtgttaagggaaggttcacgatcagccgcgacaattccaaaaagaccctttatctccaaatgaactcactgcgcgccgaagatacggccgtctactactgtgcacggaaaagaggcagaaccaccgtgtcctggggcctggtttacttcgattactggggtcagggcaccgtagtgactgtgagcagcggaggcgggggttctggtggcggaggatcaggcggcggaggaagtggtgggggcggctccggtgggagcgagctgactcagtctccgggaactcttagtttgtctcccggcgagcgagcgacactctcttgccgagcgtcccactccgtgtctcgagcctatctggcctggtatcaacagaaacctgggcaggcaccccggctgctgatttacgggacttcctcacgggctacaggtatccctgacaggttttccggcagtggctccgggacagacttcaccctgactatatcaaggctggaaccagaagactttgccgtgtattactgccagcagtacggagggtcaccttggttcgggcagggaacaaaggtggagcttaagggcgccgcctccgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgaccgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggccgcagctctgcagcagcggaaaaggagaaacaccattcacgagtttaagaagtccgcgaagaccacactgattaagattgatcccgcccttaaaatcaagacaaagaaggtgaacacggctgaccagtgtgctaatcgctgcacaaggaataaaggactgccatttacttgtaaagcctttgtattcgataaggcacgcaagcagtgcctctggttccctttcaattctatgagcagtggtgttaagaaagagtttggccatgaattcgacttgtacgaaaacaaagattatatccggaactgcattatcgggaaaggccggtcttacaaaggcaccgtctccataaccaagagtggcatcaaatgtcaaccctggagctcaatgatcccacatgaacactccttcctcccaagttcataccggggcaaggacctgcaagagaactattgcagaaatccgcgaggggaagagggagggccttggtgtttcacttctaatcccgaggtgaggtatgaggtgtgcgacatacctcagtgcggtggaagccaccatcaccaccaccattagtga

SEQ ID NO: 112 - protein, 1023 aa, Artificial Sequence [sequence omitted]

SEQ ID NO: 113 - DNA, 3075 bp, Artificial Sequence
  Synthetic construct
gaagtgcagcttcagcagagcgggcctgaactggttaaaccaggtgccagcatgaagatttcctgtaaggcttctgggtacagtttcaccgggtacaccatgaaatgggtgaagcaaagccacggaaagaaccttgagtggattggattgatcaacccctataatgggggaactagctataaccagaagttcaaggggaaggctactctgacggtggacaagtcatcaagcaccgcatatatggagctcctctccctgacttctgacgacagcgcagtatactattgcgccagagagggggactacgatggggctatggactactggggccaggggacaagcgtcactgtctccggtggaggtggctccggtggcggcggaagcggcggtggaggctcagggggcggaggctctggcggctcagacatccagatgacccaatccccgtcttccctctctgcctccttgggcgggaaggtgacaatcacgtgcaaaagttcccaggatatcaataaatacatcgcctggtaccaacacaaaccaggcaaaggccctggactgctgatacattataccagtaccttgcagcccggcataccctctcggttcagcggcagtggatcaggtcgcgattacagttttagtatttcaaatctggatcctgagaatattgcagcgtattactgtctccagtatgataacctgtacacatttggagggggaacaaggctggaaggcgccgcctccgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgaccgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggccgcagctctgcagcagcggaaaaggagaaacaccattcacgagtttaagaagtccgcgaagaccacactgattaagattgatcccgcccttaaaatcaagacaaagaaggtgaacacggctgaccagtgtgctaatcgctgcacaaggaataaaggactgccatttacttgtaaagcctttgtattcgataaggcacgcaagcagtgcctctggttccctttcaattctatgagcagtggtgttaagaaagagtttggccatgaattcgacttgtacgaaaacaaagattatatccggaactgcattatcgggaaaggccggtcttacaaaggcaccgtctccataaccaagagtggcatcaaatgtcaaccctggagctcaatgatcccacatgaacactccttcctcccaagttcataccggggcaaggacctgcaagagaactattgcagaaatccgcgaggggaagagggagggccttggtgtttcacttctaatcccgaggtgaggtatgaggtgtgcgacatacctcagtgcggtggaagccaccatcaccaccaccattagtga

SEQ ID NO: 114 - protein, 990 aa, Artificial Sequence
  Synthetic construct
AQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGGPETLCGAELVDALQFVCGDRGFYFNKPTGYGSSSRRAPQTGIVDECCFRSCDLRRLEMYCAPLKPAKSAGGSHHHHHH

SEQ ID NO: 115 - DNA, 2976 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgatttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtaacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagctacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtaacacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtggacctgaaaccttatgtggagctgaacttgtggatgctctacaatttgtttgtggcgatagagggttctacttcaacaaacccactggatatggtagttcctcaagacgagctcctcagacaggtattgtcgacgagtgttgttttaggtcttgcgacttgcgtagactggagatgtactgcgcaccattgaagccagcaaagtctgccggtggttcacatcaccaccatcaccattagtga

SEQ ID NO: 116 - protein, 992 aa, Artificial Sequence
  Synthetic construct
AQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGSTSHLVKCAEKEKTFCVNGGECFMVKDLSNPSRYLCKCPNEFTGDRCQNYVMASFYKHLGIEFMEAEELYQKGGSHHHHHH

SEQ ID NO: 117 - DNA, 2982 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgatttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtaacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagctacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtaacacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggttctacttcccatttggtgaagtgtgcagaaaaggaaaagacattttgtgtaaacggtggggagtgctttatggttaaggacttgagtaatccttcaagatatctttgcaaatgtccaaatgagtttaccggagatcgttgtcaaaactacgtcatggcctccttctacaaacacttaggtattgaattcatggaagctgaggaactgtatcagaaaggaggctctcatcaccaccatcaccattagtga

SEQ ID NO: 118 - protein, 1066 aa, Artificial Sequence
  Synthetic construct
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKSGGSHHHHHH

SEQ ID NO: 119 - DNA, 3204 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgagttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtgacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagagacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtgatacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtcccgccttgccagaggatggcggttctggagcttttcctccaggtcacttcaaagatccaaaaagattgtattgcaaaaacggtgggtttttccttcgaatacatcctgacggtagagttgacggggtaagagaaaagagtgacccacatatcaagctacagttacaagccgaggaaagaggagttgtctcaatcaagggcgtttgtgctaacagatacttggctatgaaggaagatggtagactgcttgctagtaagtgtgtcactgatgaatgtttctttttcgaaagattggagtccaataactataacacgtacaggtcacgtaagtatacgagttggtacgtggctctgaaacgtacaggccagtataagttaggttcaaaaactggacccggacagaaagctatcttattcctacccatgtctgcaaagtctggcggtagtcaccatcaccatcatcattagtga

SEQ ID NO: 120 - protein, 992 aa, Artificial Sequence
  Synthetic construct
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGSTSHLVKCAEKEKTFCVNGGECFMVKDLSNPSRYLCKCPNEFTGDRCQNYVMASFYKHLGIEFMEAEELYQKGGSHHHHHH

SEQ ID NO: 121 - DNA, 2982 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgagttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtgacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagagacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtgatacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggttctacttcacatcttgtgaaatgcgccgaaaaagagaaaacattttgtgtgaatggtggagagtgctttatggttaaagatttgtctaaccctagtagatacctgtgcaaatgtcccaatgaattcacaggtgacagatgtcagaactatgttatggctagtttctacaaacatctgggcattgagttcatggaagccgaggaattgtatcaaaaaggtggatcccaccatcaccaccatcattagtga

SEQ ID NO: 122 - protein, 1068 aa, Artificial Sequence [sequence omitted]

SEQ ID NO: 123 - DNA, 3210 bp, Artificial Sequence
  Synthetic construct
ccagctttgcctgaggatggaggctctggtgcttttcctcctggtcatttcaaagacccaaaaagactgtattgcaaaaacggtgggtttttcctgaggattcatccagatgggagggtcgatggagttagagagaaatcagacccccacattaagcttcaactacaggctgaggaacgtggtgttgtctccatcaagggtgtttgtgcaaatcgatacttagctatgaaagaggacggcagattacttgccagtaagtgtgtaactgatgaatgtttctttttcgaaagactagaatccaataactacaatacttaccgttctcgtaagtatacatcatggtacgtggccttgaagagaacgggacaatacaaattgggttctaagaccggaccaggacagaaagcaatcttgtttttgcccatgtcagctaagagtggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagatctgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtaatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggccacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtaatacttccggtgattacaaaaaggctttgttgttgttatgtggagaggatgacggaggttcacatcaccatcatcaccattagtga

SEQ ID NO: 124 - protein, 991 aa, Artificial Sequence
  Synthetic construct
LESGGGLVQPGGSLRLSCAGSGFTFSSYAMSWVRQAPGKGLEWVSSISGSGGSTYYADSVKGRFTISRDNSKKTLYLQMNSLRAEDTAVYYCARKRGRTTVSWGLVYFDYWGQGTVVTVSSGGGGSGGGGSGGGGSGGSELTQSPGTLSLSPGERATLSCRASHSVSRAYLAWYQQKPGQAPRLLIYGTSSRATGIPDRFSGSGSGTDFTLTISRLEPEDFAVYYCQQYGGSPWFGQGTKVELKASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKSGGSHHHHHH

SEQ ID NO: 125 - DNA, 2979 bp, Artificial Sequence
  Synthetic construct
ttggagagtgggggtggcttggttcaacccggtggatctttgagattgtcatgtgccggttctggttttacctttagttcctatgctatgtcttgggtccgtcaagccccaggcaaaggacttgaatgggtatcatcaatctccgggtcaggtggtagtacgtattacgcagattctgtgaaaggtaggtttaccatttccagagataactccaaaaagacattgtacttgcaaatgaatagtctgagagctgaggatactgccgtctattactgtgcccgaaaaagaggcagaactacagttagttggggtcttgtctactttgactactggggtcaggggacggtcgttaccgtatcttccggtggagggggttctggaggaggaggatctggtggtggtggaagtggaggttctgaattgacccaatctcctggtactctgtctctaagtccaggagaacgagccacgttgtcatgtagggcctcacattcagtttcaagagcttatcttgcctggtatcaacagaaacctggacaggccccacgtttgttgatatacggcaccagttccagggctacaggaataccagataggttttctggatctggctcaggaacggatttcactttgacaatttcaagactagagccagaggactttgccgtatactactgtcaacaatatggaggatcaccttggttcggacagggtactaaagttgaacttaaagctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtcccgccttgccagaggatggcggttctggagcttttcctccaggtcacttcaaagatccaaaaagattgtattgcaaaaacggtgggtttttccttcgaatacatcctgacggtagagttgacggggtaagagaaaagagtgacccacatatcaagctacagttacaagccgaggaaagaggagttgtctcaatcaagggcgtttgtgctaacagatacttggctatgaaggaagatggtagactgcttgctagtaagtgtgtcactgatgaatgtttctttttcgaaagattggagtccaataactataacacgtacaggtcacgtaagtatacgagttggtacgtggctctgaaacgtacaggccagtataagttaggttcaaaaactggacccggacagaaagctatcttattcctacccatgtctgcaaagtctggcggtagtcaccatcaccatcatcattagtga

SEQ ID NO: 126 - protein, 917 aa, Artificial Sequence
  Synthetic construct
LESGGGLVQPGGSLRLSCAGSGFTFSSYAMSWVRQAPGKGLEWVSSISGSGGSTYYADSVKGRFTISRDNSKKTLYLQMNSLRAEDTAVYYCARKRGRTTVSWGLVYFDYWGQGTVVTVSSGGGGSGGGGSGGGGSGGSELTQSPGTLSLSPGERATLSCRASHSVSRAYLAWYQQKPGQAPRLLIYGTSSRATGIPDRFSGSGSGTDFTLTISRLEPEDFAVYYCQQYGGSPWFGQGTKVELKASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGSTSHLVKCAEKEKTFCVNGGECFMVKDLSNPSRYLCKCPNEFTGDRCQNYVMASFYKHLGIEFMEAEELYQKGGSHHHHHH

SEQ ID NO: 127 - DNA, 2757 bp, Artificial Sequence
  Synthetic construct
ttggagagtgggggtggcttggttcaacccggtggatctttgagattgtcatgtgccggttctggttttacctttagttcctatgctatgtcttgggtccgtcaagccccaggcaaaggacttgaatgggtatcatcaatctccgggtcaggtggtagtacgtattacgcagattctgtgaaaggtaggtttaccatttccagagataactccaaaaagacattgtacttgcaaatgaatagtctgagagctgaggatactgccgtctattactgtgcccgaaaaagaggcagaactacagttagttggggtcttgtctactttgactactggggtcaggggacggtcgttaccgtatcttccggtggagggggttctggaggaggaggatctggtggtggtggaagtggaggttctgaattgacccaatctcctggtactctgtctctaagtccaggagaacgagccacgttgtcatgtagggcctcacattcagtttcaagagcttatcttgcctggtatcaacagaaacctggacaggccccacgtttgttgatatacggcaccagttccagggctacaggaataccagataggttttctggatctggctcaggaacggatttcactttgacaatttcaagactagagccagaggactttgccgtatactactgtcaacaatatggaggatcaccttggttcggacagggtactaaagttgaacttaaagctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggttctacttcacatcttgtgaaatgcgccgaaaaagagaaaacattttgtgtgaatggtggagagtgctttatggttaaagatttgtctaaccctagtagatacctgtgcaaatgtcccaatgaattcacaggtgacagatgtcagaactatgttatggctagtttctacaaacatctgggcattgagttcatggaagccgaggaattgtatcaaaaaggtggatcccaccatcaccaccatcattagtga

SEQ ID NO: 128 - protein, 1051 aa, Artificial Sequence
  Synthetic construct
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGMSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSGGSHHHHHH

SEQ ID NO: 129 - DNA, 3159 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgagttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtgacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagagacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtgatacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtatgagtcctttgttgagaaggttgctattagctgcattgttacagttagctcctgctcaggccccagtttctcagccagacgcccctggtcatcaacgtaaggttgtgtcttggattgacgtatacacgagagcaacatgccaaccaagggaagtcgttgttccccttactgttgagttgatggggactgtggctaagcagctggtcccttcatgtgtcaccgtacagagatgtggaggttgttgcccagacgatggactagaatgtgttccaacaggacaacatcaggtgagaatgcaaatactgatgatcagatatccatcttcacaacttggcgaaatgtccctggaagagcactctcaatgcgagtgtcgacccaaaaagaaagatagtggtggttcccatcaccaccatcatcattagtga

SEQ ID NO: 130 - protein, 1108 aa, Artificial Sequence
  Synthetic construct
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGMSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDSPRPLCPRCTQHHQRPDPRTCRRRCRRRSFLRCQGRGLELNPDTCRCRKLRRGGSHHHHHH

SEQ ID NO: 131 - DNA, 3330 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgagttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtgacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagagacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtgatacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtatgagtcctttgcttagaaggttgttactggccgcactgcttcaacttgcaccagctcaagccccagtctctcaacctgacgctcccggtcatcagagaaaggtggtatcatggattgatgtgtatactcgtgctacatgccaaccccgtgaggttgttgtacctttgacagtcgaattgatgggaaccgttgccaagcagttagttccttcctgtgtcacagtgcagagatgtggaggatgttgtccagatgatggtttggagtgtgtacctactggccaacatcaggttagaatgcagatcttgatgatacgttacccatcaagtcaactaggtgaaatgtctttggaggaacactcccagtgcgaatgcagacccaaaaagaaagattctgctgttaaaccagactctccaagaccattatgtcccagatgcacgcaacaccatcaaagaccagatccaaggacttgtagacgtagatgcaggaggcgatcctttttgcgatgccaaggtagaggcctagagctgaatcctgacacctgtcgatgtcgaaagttaagacgtggtgggtcacaccaccatcaccatcattagtga

SEQ ID NO: 132 - protein, 1095 aa, Artificial Sequence
  Synthetic construct
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCGGSHHHHHH

SEQ ID NO: 133 - DNA, 3291 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgagttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtgacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagagacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtgatacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtcaacgtaaaagacgaaatacaattcatgagttcaaaaagtcagccaaaactacattgattaagattgatcccgctctgaagataaagaccaaaaaggtcaacacagctgaccagtgcgccaacaggtgtaccaggaataagggactaccttttacttgtaaagctttcgtattcgacaaagcaaggaagcaatgtctgtggttcccctttaactctatgtcatctggggtgaaaaaggaatttggccatgaatttgatttgtatgaaaacaaagattacattagaaattgcattatcggcaagggaagatcatacaaaggtacggtttctattactaagtctggaatcaagtgccaaccatggtcatccatgatccctcacgagcacagtttccttccaagttcctaccgtggtaaagacttacaagagaactattgccgaaatcctagaggtgaagagggaggtccatggtgttttacctccaaccctgaagttagatatgaagtctgtgatatacctcagtgtggcggttctcatcatcaccaccaccattagtga

SEQ ID NO: 134 - protein, 990 aa, Artificial Sequence
  Synthetic construct
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGGPETLCGAELVDALQFVCGDRGFYFNKPTGYGSSSRRAPQTGIVDECCFRSCDLRRLEMYCAPLKPAKSAGGSHHHHHH

SEQ ID NO: 135 - DNA, 2976 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgagttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtgacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagagacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtgatacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtggacctgaaaccttatgtggagctgaacttgtggatgctctacaatttgtttgtggcgatagagggttctacttcaacaaacccactggatatggtagttcctcaagacgagctcctcagacaggtattgtcgacgagtgttgttttaggtcttgcgacttgcgtagactggagatgtactgcgcaccattgaagccagcaaagtctgccggtggttcacatcaccaccatcaccattagtga

SEQ ID NO: 136 - protein, 992 aa, Artificial Sequence
  Synthetic construct
GPETLCGAELVDALQFVCGDRGFYFNKPTGYGSSSRRAPQTGIVDECCFRSCDLRRLEMYCAPLKPAKSAGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDDGGSHHHHHH

SEQ ID NO: 137 - DNA, 2982 bp, Artificial Sequence
  Synthetic construct
ggaccagagacattgtgtggagcagaactggtggacgctttacagtttgtgtgtggtgaccgtggtttctacttcaacaaacctacgggttacgggtctagttctcgtagagctccacagactgggattgtagatgaatgctgcttcagatcttgtgaccttcgacgtttagaaatgtactgtgcacctctaaaaccagccaaatctgctggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagaactgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtgatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggaaacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtgatacttccggtgattacaaaaaggctttgttgttgttatgtggagaggatgacggaggttcacatcaccatcatcaccattagtga

SEQ ID NO: 138 - protein, 992 aa, Artificial Sequence
  Synthetic construct
GPETLCGAELVDALQFVCGDRGFYFNKPTGYGSSSRRAPQTGIVDECCFRSCDLRRLEMYCAPLKPAKSAGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGAQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDGGSHHHHHH

SEQ ID NO: 139 - DNA, 2982 bp, Artificial Sequence
  Synthetic construct
ggaccagagacattgtgtggagcagaactggtggacgctttacagtttgtgtgtggtgaccgtggtttctacttcaacaaacctacgggttacgggtctagttctcgtagagctccacagactgggattgtagatgaatgctgcttcagatcttgtgaccttcgacgtttagaaatgtactgtgcacctctaaaaccagccaaatctgctggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagatctgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtaatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggccacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtaatacttccggtgattacaaaaaggctttgttgttgttatgtggagaggatgacggaggttcacatcaccatcatcaccattagtga

SEQ ID NO: 140 - protein, 1097 aa, Artificial Sequence [sequence omitted]

SEQ ID NO: 141 - DNA, 3297 bp, Artificial Sequence
  Synthetic construct
caacgtaagcgtcgaaacactatccatgagttcaaaaagtctgcaaaaactactttgataaagatagacccagctttgaagataaagacgaaaaaggtcaatactgccgaccagtgtgctaatcgatgtactagaaacaagggcttaccctttacttgtaaggcttttgttttcgacaaagcaaggaagcaatgtttatggttccccttcaattcaatgagttctggtgtgaaaaaggaatttggtcatgaatttgatttgtacgagaacaaagattacattagaaactgcattatcggcaaaggaagatcttacaaggggacggtgtctataacaaagagtggcataaagtgtcaaccatggtctagtatgattccacatgagcactctttccttccctcctcctatcgaggaaaagacctacaagagaactattgtcgaaaccctagaggagaagagggaggcccttggtgctttacgagtaaccctgaggttagatacgaagtttgtgacattccacaatgcggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagaactgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtgatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggaaacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtgatacttccggtgattacaaaaaggctttgttgttgttatgtggagaggatgacggaggttcacatcaccatcatcaccattagtga

SEQ ID NO: 142 - protein, 994 aa, Artificial Sequence
  Synthetic construct
STSHLVKCAEKEKTFCVNGGECFMVKDLSNPSRYLCKCPNEFTGDRCQNYVMASFYKHLGIEFMEAEELYQKGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDDGGSHHHHHH

SEQ ID NO: 143 - DNA, 2988 bp, Artificial Sequence
  Synthetic construct
tccacttctcatttggtgaaatgcgccgagaaggagaaaacgttctgcgtgaacggtggtgaatgctttatggtcaaagatctgtctaacccttctcgatatctttgtaagtgtcccaacgagtttactggtgatcgatgtcagaactacgttatggcttccttttacaaacacttgggtatagaattcatggaggccgaggagttgtaccaaaaaggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagaactgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtgatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggaaacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtgatacttccggtgattacaaaaaggctttgttgttgttatgtggagaggatgacggaggttcacatcaccatcatcaccattagtga

SEQ ID NO: 144 - protein, 1068 aa, Artificial Sequence
  Synthetic construct
PALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKSGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDDGGSHHHHHH

SEQ ID NO: 145 - DNA, 3210 bp, Artificial Sequence
  Synthetic construct
ccagctttgcctgaggatggaggctctggtgcttttcctcctggtcatttcaaagacccaaaaagactgtattgcaaaaacggtgggtttttcctgaggattcatccagatgggagggtcgatggagttagagagaaatcagacccccacattaagcttcaactacaggctgaggaacgtggtgttgtctccatcaagggtgtttgtgcaaatcgatacttagctatgaaagaggacggcagattacttgccagtaagtgtgtaactgatgaatgtttctttttcgaaagactagaatccaataactacaatacttaccgttctcgtaagtatacatcatggtacgtggccttgaagagaacgggacaatacaaattgggttctaagaccggaccaggacagaaagcaatcttgtttttgcccatgtcagctaagagtggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagaactgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtgatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggaaacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtgatacttccggtgattacaaaaaggctttgttgttgttatgtggagaggatgacggaggttcacatcaccatcatcaccattagtga

SEQ ID NO: 146 - protein, 1110 aa, Artificial Sequence [sequence omitted]

SEQ ID NO: 147 - DNA, 3336 bp, Artificial Sequence
  Synthetic construct
atgtctcctttgctgagaaggttactattggctgcattgttgcagttagccccagcccaagctcccgtttcccaaccagatgcacctggtcatcaacgaaaggtggtttcctggatcgatgtctacacgagagctacctgtcaaccaagggaagttgtagttcccttaactgtggagcttatgggtacagtagccaagcaattagttccctcatgtgtcactgttcagcgatgtggagggtgttgtcctgacgacggcctagagtgcgtcccaacaggacagcaccaagtgagaatgcaaattctgatgatacgatatcctagttctcagttgggtgaaatgagtttggaggagcattctcaatgcgaatgtagacccaaaaagaaagattccgctgtcaaaccagactctcctagaccactatgcccaagatgcactcaacaccaccagcgtcctgatcctagaacttgtaggcgtagatgtcgtagaagatcattccttagatgtcagggaagaggtcttgaattgaatccagacacctgccgatgtcgtaagctgcgtaggggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagaactgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtgatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggaaacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtgatacttccggtgattacaaaaaggctttgttgttgttatgtggagaggatgacggaggttcacatcaccatcatcaccattagtga

SEQ ID NO: 148 - protein, 1053 aa, Artificial Sequence
  Synthetic construct
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDDGGSHHHHHH

SEQ ID NO: 149 - DNA, 3165 bp, Artificial Sequence
  Synthetic construct
atgagtcctttgctaagacgtttacttttggctgccttattgcagctggcaccagcccaagcaccagtgtcacagccagatgctcccggtcaccagagaaaagtggttagttggattgatgtttacacgagggctacatgccaacctagagaagtagttgtccctctgacagttgaactaatggggaccgttgctaagcaattggtgccttcctgtgtcactgttcagcgatgcggaggatgttgtccagacgacggtctggaatgcgtaccaactggccaacatcaagtcagaatgcagatcttgatgataagatatccatcttcccaattaggagaaatgtcacttgaggaacattctcaatgtgagtgtaggcccaaaaagaaggattctggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagaactgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtgatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggaaacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtgatacttccggtgattacaaaaaggctttgttgttgttatgtggagaggatgacggaggttcacatcaccatcatcaccattagtga

SEQ ID NO: 150 - protein, 934 aa, Artificial Sequence
  Synthetic construct
GPETLCGAELVDALQFVCGDRGFYFNKPTGYGSSSRRAPQTGIVDECCFRSCDLRRLEMYCAPLKPAKSAGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLGSTGGGSGGGTGEVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKITGAYSSSWYYDNWFDPWGQGTLVTVSSGGGGSGGGGSGGGGSGGSSYELTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVLGQGGSGGHHHHHH

SEQ ID NO: 151 - DNA, 2808 bp, Artificial Sequence
  Synthetic construct
ggaccagagacattgtgtggagcagaactggtggacgctttacagtttgtgtgtggtgaccgtggtttctacttcaacaaacctacgggttacgggtctagttctcgtagagctccacagactgggattgtagatgaatgctgcttcagatcttgtgaccttcgacgtttagaaatgtactgtgcacctctaaaaccagccaaatctgctggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagggtcgactgggggagggagcggtggaggaaccggtgaggtgcagttggtcgaatcaggaggaggtttagtgcagcccggtggatcacttaggctgagttgctccgcatctggtttcactttctcttcctatgccatgcattgggtacgtcaggcaccggggaaaggactagaatacgtatcagccatatcttctaatggcggatcaacctactatgctgattcagttaaaggtagattcactatctcaagagataactccaaaaacacattgtaccttcaaatgagttcactgcgtgctgaggacacagctgtctattactgtgtaaagattactggagcctactctagttcctggtactacgacaattggtttgatccttggggccaaggaaccttagttacggtttccagtggcggtgggggatctggcggaggtgggagtggtggagggggttctggtggatcatcttatgaattgacccagcccccttctgtgtctgttagccctggacagactgccagcattacctgttccggcgataagctaggtgacaagtacgcttgctggtatcaacaaaagccagggcagtcaccagtgcttgtcatctaccaagattctaagaggccaagtggaataccagaacgattttctggctccaacagtggcaatacagctaccctgacaatttccggtacgcaagcaatggatgaggctgactactattgtcaggcctgggattcgtcaactgctgtgtttggtggtggtactaaactcactgtcttgggtcaaggcggatcaggtggtcaccaccatcatcaccattagtga

SEQ ID NO: 152 - protein, 810 aa, Artificial Sequence
  Synthetic construct
GPETLCGAELVDALQFVCGDRGFYFNKPTGYGSSSRRAPQTGIVDECCFRSCDLRRLEMYCAPLKPAKSAGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLGSTGGGSGGGTGEKLGKLQYSLDYDFQNNQLLVGIIQAAELPALDMGGTSDPYVKVFLLPDKKKKFETKVHRKTLNPVFNEQFTFKVPYSELGGKTLVMAVYDFDRFSKHDIIGEFKVPMNTVDFGHVTEEWRDLQSAEKGGSGGHHHHHH

SEQ ID NO: 153 - DNA, 2436 bp, Artificial Sequence
  Synthetic construct
ggaccagagacattgtgtggagcagaactggtggacgctttacagtttgtgtgtggtgaccgtggtttctacttcaacaaacctacgggttacgggtctagttctcgtagagctccacagactgggattgtagatgaatgctgcttcagatcttgtgaccttcgacgtttagaaatgtactgtgcacctctaaaaccagccaaatctgctggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagggtcgactgggggagggagcggtggaggaaccggtgaaaagctgggaaagctgcaatacagtttggactacgatttccaaaacaatcagttgctcgtcggcattatccaggctgccgaattgccagctttagatatgggtggtacatcagatccctacgtcaaagtatttctactgcctgacaaaaagaaaaagtttgaaactaaggtgcacagaaaaacgcttaacccagttttcaacgagcagtttacattcaaagttccttattctgaacttggaggaaaaactctagtgatggccgtttatgatttcgataggttttctaagcatgacatcataggggagtttaaggtcccaatgaatactgttgatttcggtcatgtgaccgaggaatggcgtgaccttcaatccgcagagaaaggcggatcaggtggtcaccaccatcatcaccattagtga

SEQ ID NO: 154 - protein, 926 aa, Artificial Sequence
  Synthetic construct
GPETLCGAELVDALQFVCGDRGFYFNKPTGYGSSSRRAPQTGIVDECCFRSCDLRRLEMYCAPLKPAKSAGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLGSTGGGSGGGTGLESGGGLVQPGGSLRLSCAGSGFTFSSYAMSWVRQAPGKGLEWVSSISGSGGSTYYADSVKGRFTISRDNSKKTLYLQMNSLRAEDTAVYYCARKRGRTTVSWGLVYFDYWGQGTVVTVSSGGGGSGGGGSGGGGSGGSELTQSPGTLSLSPGERATLSCRASHSVSRAYLAWYQQKPGQAPRLLIYGTSSRATGIPDRFSGSGSGTDFTLTISRLEPEDFAVYYCQQYGGSPWFGQGTKVELKGGSGGHHHHHH

SEQ ID NO: 155 - DNA, 2784 bp, Artificial Sequence
  Synthetic construct
ggaccagagacattgtgtggagcagaactggtggacgctttacagtttgtgtgtggtgaccgtggtttctacttcaacaaacctacgggttacgggtctagttctcgtagagctccacagactgggattgtagatgaatgctgcttcagatcttgtgaccttcgacgtttagaaatgtactgtgcacctctaaaaccagccaaatctgctggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagggtcgactgggggagggagcggtggaggaaccggtttggagagtgggggtggcttggttcaacccggtggatctttgagattgtcatgtgccggttctggttttacctttagttcctatgctatgtcttgggtccgtcaagccccaggcaaaggacttgaatgggtatcatcaatctccgggtcaggtggtagtacgtattacgcagattctgtgaaaggtaggtttaccatttccagagataactccaaaaagacattgtacttgcaaatgaatagtctgagagctgaggatactgccgtctattactgtgcccgaaaaagaggcagaactacagttagttggggtcttgtctactttgactactggggtcaggggacggtcgttaccgtatcttccggtggagggggttctggaggaggaggatctggtggtggtggaagtggaggttctgaattgacccaatctcctggtactctgtctctaagtccaggagaacgagccacgttgtcatgtagggcctcacattcagtttcaagagcttatcttgcctggtatcaacagaaacctggacaggccccacgtttgttgatatacggcaccagttccagggctacaggaataccagataggttttctggatctggctcaggaacggatttcactttgacaatttcaagactagagccagaggactttgccgtatactactgtcaacaatatggaggatcaccttggttcggacagggtactaaagttgaacttaaaggcggatcaggtggtcaccaccatcatcaccattagtga

SEQ ID NO: 156 - protein, 936 aa, Artificial Sequence
  Synthetic construct
STSHLVKCAEKEKTFCVNGGECFMVKDLSNPSRYLCKCPNEFTGDRCQNYVMASFYKHLGIEFMEAEELYQKGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLGSTGGGSGGGTGEVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKITGAYSSSWYYDNWFDPWGQGTLVTVSSGGGGSGGGGSGGGGSGGSSYELTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVLGQGGSGGHHHHHH

SEQ ID NO: 157 - DNA, 2814 bp, Artificial Sequence
  Synthetic construct
tccacttctcatttggtgaaatgcgccgagaaggagaaaacgttctgcgtgaacggtggtgaatgctttatggtcaaagatctgtctaacccttctcgatatctttgtaagtgtcccaacgagtttactggtgatcgatgtcagaactacgttatggcttccttttacaaacacttgggtatagaattcatggaggccgaggagttgtaccaaaaaggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagggtcgactgggggagggagcggtggaggaaccggtgaggtgcagttggtcgaatcaggaggaggtttagtgcagcccggtggatcacttaggctgagttgctccgcatctggtttcactttctcttcctatgccatgcattgggtacgtcaggcaccggggaaaggactagaatacgtatcagccatatcttctaatggcggatcaacctactatgctgattcagttaaaggtagattcactatctcaagagataactccaaaaacacattgtaccttcaaatgagttcactgcgtgctgaggacacagctgtctattactgtgtaaagattactggagcctactctagttcctggtactacgacaattggtttgatccttggggccaaggaaccttagttacggtttccagtggcggtgggggatctggcggaggtgggagtggtggagggggttctggtggatcatcttatgaattgacccagcccccttctgtgtctgttagccctggacagactgccagcattacctgttccggcgataagctaggtgacaagtacgcttgctggtatcaacaaaagccagggcagtcaccagtgcttgtcatctaccaagattctaagaggccaagtggaataccagaacgattttctggctccaacagtggcaatacagctaccctgacaatttccggtacgcaagcaatggatgaggctgactactattgtcaggcctgggattcgtcaactgctgtgtttggtggtggtactaaactcactgtcttgggtcaaggcggatcaggtggtcaccaccatcatcaccattagtga

SEQ ID NO: 158 - protein, 812 aa, Artificial Sequence
  Synthetic construct
STSHLVKCAEKEKTFCVNGGECFMVKDLSNPSRYLCKCPNEFTGDRCQNYVMASFYKHLGIEFMEAEELYQKGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLGSTGGGSGGGTGEKLGKLQYSLDYDFQNNQLLVGIIQAAELPALDMGGTSDPYVKVFLLPDKKKKFETKVHRKTLNPVFNEQFTFKVPYSELGGKTLVMAVYDFDRFSKHDIIGEFKVPMNTVDFGHVTEEWRDLQSAEKGGSGGHHHHHH

SEQ ID NO: 159 - DNA, 2442 bp, Artificial Sequence
  Synthetic construct
tccacttctcatttggtgaaatgcgccgagaaggagaaaacgttctgcgtgaacggtggtgaatgctttatggtcaaagatctgtctaacccttctcgatatctttgtaagtgtcccaacgagtttactggtgatcgatgtcagaactacgttatggcttccttttacaaacacttgggtatagaattcatggaggccgaggagttgtaccaaaaaggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagggtcgactgggggagggagcggtggaggaaccggtgaaaagctgggaaagctgcaatacagtttggactacgatttccaaaacaatcagttgctcgtcggcattatccaggctgccgaattgccagctttagatatgggtggtacatcagatccctacgtcaaagtatttctactgcctgacaaaaagaaaaagtttgaaactaaggtgcacagaaaaacgcttaacccagttttcaacgagcagtttacattcaaagttccttattctgaacttggaggaaaaactctagtgatggccgtttatgatttcgataggttttctaagcatgacatcataggggagtttaaggtcccaatgaatactgttgatttcggtcatgtgaccgaggaatggcgtgaccttcaatccgcagagaaaggcggatcaggtggtcaccaccatcatcaccattagtga

SEQ ID NO: 160 - protein, 928 aa, Artificial Sequence
  Synthetic construct
STSHLVKCAEKEKTFCVNGGECFMVKDLSNPSRYLCKCPNEFTGDRCQNYVMASFYKHLGIEFMEAEELYQKGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLGSTGGGSGGGTGLESGGGLVQPGGSLRLSCAGSGFTFSSYAMSWVRQAPGKGLEWVSSISGSGGSTYYADSVKGRFTISRDNSKKTLYLQMNSLRAEDTAVYYCARKRGRTTVSWGLVYFDYWGQGTVVTVSSGGGGSGGGGSGGGGSGGSELTQSPGTLSLSPGERATLSCRASHSVSRAYLAWYQQKPGQAPRLLIYGTSSRATGIPDRFSGSGSGTDFTLTISRLEPEDFAVYYCQQYGGSPWFGQGTKVELKGGSGGHHHHHH

SEQ ID NO: 161 - DNA, 2790 bp, Artificial Sequence
  Synthetic construct
tccacttctcatttggtgaaatgcgccgagaaggagaaaacgttctgcgtgaacggtggtgaatgctttatggtcaaagatctgtctaacccttctcgatatctttgtaagtgtcccaacgagtttactggtgatcgatgtcagaactacgttatggcttccttttacaaacacttgggtatagaattcatggaggccgaggagttgtaccaaaaaggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagggtcgactgggggagggagcggtggaggaaccggtttggagagtgggggtggcttggttcaacccggtggatctttgagattgtcatgtgccggttctggttttacctttagttcctatgctatgtcttgggtccgtcaagccccaggcaaaggacttgaatgggtatcatcaatctccgggtcaggtggtagtacgtattacgcagattctgtgaaaggtaggtttaccatttccagagataactccaaaaagacattgtacttgcaaatgaatagtctgagagctgaggatactgccgtctattactgtgcccgaaaaagaggcagaactacagttagttggggtcttgtctactttgactactggggtcaggggacggtcgttaccgtatcttccggtggagggggttctggaggaggaggatctggtggtggtggaagtggaggttctgaattgacccaatctcctggtactctgtctctaagtccaggagaacgagccacgttgtcatgtagggcctcacattcagtttcaagagcttatcttgcctggtatcaacagaaacctggacaggccccacgtttgttgatatacggcaccagttccagggctacaggaataccagataggttttctggatctggctcaggaacggatttcactttgacaatttcaagactagagccagaggactttgccgtatactactgtcaacaatatggaggatcaccttggttcggacagggtactaaagttgaacttaaaggcggatcaggtggtcaccaccatcatcaccattagtga

SEQ ID NO: 162 - protein, 1010 aa, Artificial Sequence [sequence omitted]

SEQ ID NO: 163 - DNA, 3036 bp, Artificial Sequence
  Synthetic construct
ccagctttgcctgaggatggaggctctggtgcttttcctcctggtcatttcaaagacccaaaaagactgtattgcaaaaacggtgggtttttcctgaggattcatccagatgggagggtcgatggagttagagagaaatcagacccccacattaagcttcaactacaggctgaggaacgtggtgttgtctccatcaagggtgtttgtgcaaatcgatacttagctatgaaagaggacggcagattacttgccagtaagtgtgtaactgatgaatgtttctttttcgaaagactagaatccaataactacaatacttaccgttctcgtaagtatacatcatggtacgtggccttgaagagaacgggacaatacaaattgggttctaagaccggaccaggacagaaagcaatcttgtttttgcccatgtcagctaagagtggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagggtcgactgggggagggagcggtggaggaaccggtgaggtgcagttggtcgaatcaggaggaggtttagtgcagcccggtggatcacttaggctgagttgctccgcatctggtttcactttctcttcctatgccatgcattgggtacgtcaggcaccggggaaaggactagaatacgtatcagccatatcttctaatggcggatcaacctactatgctgattcagttaaaggtagattcactatctcaagagataactccaaaaacacattgtaccttcaaatgagttcactgcgtgctgaggacacagctgtctattactgtgtaaagattactggagcctactctagttcctggtactacgacaattggtttgatccttggggccaaggaaccttagttacggtttccagtggcggtgggggatctggcggaggtgggagtggtggagggggttctggtggatcatcttatgaattgacccagcccccttctgtgtctgttagccctggacagactgccagcattacctgttccggcgataagctaggtgacaagtacgcttgctggtatcaacaaaagccagggcagtcaccagtgcttgtcatctaccaagattctaagaggccaagtggaataccagaacgattttctggctccaacagtggcaatacagctaccctgacaatttccggtacgcaagcaatggatgaggctgactactattgtcaggcctgggattcgtcaactgctgtgtttggtggtggtactaaactcactgtcttgggtcaaggcggatcaggtggtcaccaccatcatcaccattagtga

SEQ ID NO: 164 - protein, 886 aa, Artificial Sequence [sequence omitted]

SEQ ID NO: 165 - DNA, 2664 bp, Artificial Sequence
  Synthetic construct
ccagctttgcctgaggatggaggctctggtgcttttcctcctggtcatttcaaagacccaaaaagactgtattgcaaaaacggtgggtttttcctgaggattcatccagatgggagggtcgatggagttagagagaaatcagacccccacattaagcttcaactacaggctgaggaacgtggtgttgtctccatcaagggtgtttgtgcaaatcgatacttagctatgaaagaggacggcagattacttgccagtaagtgtgtaactgatgaatgtttctttttcgaaagactagaatccaataactacaatacttaccgttctcgtaagtatacatcatggtacgtggccttgaagagaacgggacaatacaaattgggttctaagaccggaccaggacagaaagcaatcttgtttttgcccatgtcagctaagagtggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagggtcgactgggggagggagcggtggaggaaccggtgaaaagctgggaaagctgcaatacagtttggactacgatttccaaaacaatcagttgctcgtcggcattatccaggctgccgaattgccagctttagatatgggtggtacatcagatccctacgtcaaagtatttctactgcctgacaaaaagaaaaagtttgaaactaaggtgcacagaaaaacgcttaacccagttttcaacgagcagtttacattcaaagttccttattctgaacttggaggaaaaactctagtgatggccgtttatgatttcgataggttttctaagcatgacatcataggggagtttaaggtcccaatgaatactgttgatttcggtcatgtgaccgaggaatggcgtgaccttcaatccgcagagaaaggcggatcaggtggtcaccaccatcatcaccattagtga

SEQ ID NO: 166 - protein, 1002 aa, Artificial Sequence [sequence omitted]

SEQ ID NO: 167 - DNA, 3012 bp, Artificial Sequence
  Synthetic construct
ccagctttgcctgaggatggaggctctggtgcttttcctcctggtcatttcaaagacccaaaaagactgtattgcaaaaacggtgggtttttcctgaggattcatccagatgggagggtcgatggagttagagagaaatcagacccccacattaagcttcaactacaggctgaggaacgtggtgttgtctccatcaagggtgtttgtgcaaatcgatacttagctatgaaagaggacggcagattacttgccagtaagtgtgtaactgatgaatgtttctttttcgaaagactagaatccaataactacaatacttaccgttctcgtaagtatacatcatggtacgtggccttgaagagaacgggacaatacaaattgggttctaagaccggaccaggacagaaagcaatcttgtttttgcccatgtcagctaagagtggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagggtcgactgggggagggagcggtggaggaaccggtttggagagtgggggtggcttggttcaacccggtggatctttgagattgtcatgtgccggttctggttttacctttagttcctatgctatgtcttgggtccgtcaagccccaggcaaaggacttgaatgggtatcatcaatctccgggtcaggtggtagtacgtattacgcagattctgtgaaaggtaggtttaccatttccagagataactccaaaaagacattgtacttgcaaatgaatagtctgagagctgaggatactgccgtctattactgtgcccgaaaaagaggcagaactacagttagttggggtcttgtctactttgactactggggtcaggggacggtcgttaccgtatcttccggtggagggggttctggaggaggaggatctggtggtggtggaagtggaggttctgaattgacccaatctcctggtactctgtctctaagtccaggagaacgagccacgttgtcatgtagggcctcacattcagtttcaagagcttatcttgcctggtatcaacagaaacctggacaggccccacgtttgttgatatacggcaccagttccagggctacaggaataccagataggttttctggatctggctcaggaacggatttcactttgacaatttcaagactagagccagaggactttgccgtatactactgtcaacaatatggaggatcaccttggttcggacagggtactaaagttgaacttaaaggcggatcaggtggtcaccaccatcatcaccattagtga

SEQ ID NO: 168 - protein, 933 aa, Artificial Sequence
  Synthetic construct
EVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKITGAYSSSWYYDNWFDPWGQGTLVTVSSGGGGSGGGGSGGGGSGGSSYELTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVLGQGAQGGGSGGSAGDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGGPETLCGAELVDALQFVCGDRGFYFNKPTGYGSSSRRAPQTGIVDECCFRSCDLRRLEMYCAPLKPAKSAGGSHHHHHH

SEQ ID NO: 169 - DNA, 2805 bp, Artificial Sequence
  Synthetic construct
gaggtgcagttggtcgaatcaggaggaggtttagtgcagcccggtggatcacttaggctgagttgctccgcatctggtttcactttctcttcctatgccatgcattgggtacgtcaggcaccggggaaaggactagaatacgtatcagccatatcttctaatggcggatcaacctactatgctgattcagttaaaggtagattcactatctcaagagataactccaaaaacacattgtaccttcaaatgagttcactgcgtgctgaggacacagctgtctattactgtgtaaagattactggagcctactctagttcctggtactacgacaattggtttgatccttggggccaaggaaccttagttacggtttccagtggcggtgggggatctggcggaggtgggagtggtggagggggttctggtggatcatcttatgaattgacccagcccccttctgtgtctgttagccctggacagactgccagcattacctgttccggcgataagctaggtgacaagtacgcttgctggtatcaacaaaagccagggcagtcaccagtgcttgtcatctaccaagattctaagaggccaagtggaataccagaacgattttctggctccaacagtggcaatacagctaccctgacaatttccggtacgcaagcaatggatgaggctgactactattgtcaggcctgggattcgtcaactgctgtgtttggtggtggtactaaactcactgtcttgggtcaaggggcccaaggaggtggatcaggaggctctgcaggtgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtggacctgaaaccttatgtggagctgaacttgtggatgctctacaatttgtttgtggcgatagagggttctacttcaacaaacccactggatatggtagttcctcaagacgagctcctcagacaggtattgtcgacgagtgttgttttaggtcttgcgacttgcgtagactggagatgtactgcgcaccattgaagccagcaaagtctgccggtggttcacatcaccaccatcaccattagtga

SEQ ID NO: 170 - protein, 809 aa, Artificial Sequence
  Synthetic construct
EKLGKLQYSLDYDFQNNQLLVGIIQAAELPALDMGGTSDPYVKVFLLPDKKKKFETKVHRKTLNPVFNEQFTFKVPYSELGGKTLVMAVYDFDRFSKHDIIGEFKVPMNTVDFGHVTEEWRDLQSAEKGAQGGGSGGSAGDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGGPETLCGAELVDALQFVCGDRGFYFNKPTGYGSSSRRAPQTGIVDECCFRSCDLRRLEMYCAPLKPAKSAGGSHHHHHH

SEQ ID NO: 171 - DNA, 2433 bp, Artificial Sequence
  Synthetic construct
gaaaagctgggaaagctgcaatacagtttggactacgatttccaaaacaatcagttgctcgtcggcattatccaggctgccgaattgccagctttagatatgggtggtacatcagatccctacgtcaaagtatttctactgcctgacaaaaagaaaaagtttgaaactaaggtgcacagaaaaacgcttaacccagttttcaacgagcagtttacattcaaagttccttattctgaacttggaggaaaaactctagtgatggccgtttatgatttcgataggttttctaagcatgacatcataggggagtttaaggtcccaatgaatactgttgatttcggtcatgtgaccgaggaatggcgtgaccttcaatccgcagagaaaggggcccaaggaggtggatcaggaggctctgcaggtgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtggacctgaaaccttatgtggagctgaacttgtggatgctctacaatttgtttgtggcgatagagggttctacttcaacaaacccactggatatggtagttcctcaagacgagctcctcagacaggtattgtcgacgagtgttgttttaggtcttgcgacttgcgtagactggagatgtactgcgcaccattgaagccagcaaagtctgccggtggttcacatcaccaccatcaccattagtga

SEQ ID NO: 172 - protein, 925 aa, Artificial Sequence
  Synthetic construct
LESGGGLVQPGGSLRLSCAGSGFTFSSYAMSWVRQAPGKGLEWVSSISGSGGSTYYADSVKGRFTISRDNSKKTLYLQMNSLRAEDTAVYYCARKRGRTTVSWGLVYFDYWGQGTVVTVSSGGGGSGGGGSGGGGSGGSELTQSPGTLSLSPGERATLSCRASHSVSRAYLAWYQQKPGQAPRLLIYGTSSRATGIPDRFSGSGSGTDFTLTISRLEPEDFAVYYCQQYGGSPWFGQGTKVELKGAQGGGSGGSAGDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGGPETLCGAELVDALQFVCGDRGFYFNKPTGYGSSSRRAPQTGIVDECCFRSCDLRRLEMYCAPLKPAKSAGGSHHHHHH

SEQ ID NO: 173 - DNA, 2781 bp, Artificial Sequence
  Synthetic construct
ttggagagtgggggtggcttggttcaacccggtggatctttgagattgtcatgtgccggttctggttttacctttagttcctatgctatgtcttgggtccgtcaagccccaggcaaaggacttgaatgggtatcatcaatctccgggtcaggtggtagtacgtattacgcagattctgtgaaaggtaggtttaccatttccagagataactccaaaaagacattgtacttgcaaatgaatagtctgagagctgaggatactgccgtctattactgtgcccgaaaaagaggcagaactacagttagttggggtcttgtctactttgactactggggtcaggggacggtcgttaccgtatcttccggtggagggggttctggaggaggaggatctggtggtggtggaagtggaggttctgaattgacccaatctcctggtactctgtctctaagtccaggagaacgagccacgttgtcatgtagggcctcacattcagtttcaagagcttatcttgcctggtatcaacagaaacctggacaggccccacgtttgttgatatacggcaccagttccagggctacaggaataccagataggttttctggatctggctcaggaacggatttcactttgacaatttcaagactagagccagaggactttgccgtatactactgtcaacaatatggaggatcaccttggttcggacagggtactaaagttgaacttaaaggggcccaaggaggtggatcaggaggctctgcaggtgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtggacctgaaaccttatgtggagctgaacttgtggatgctctacaatttgtttgtggcgatagagggttctacttcaacaaacccactggatatggtagttcctcaagacgagctcctcagacaggtattgtcgacgagtgttgttttaggtcttgcgacttgcgtagactggagatgtactgcgcaccattgaagccagcaaagtctgccggtggttcacatcaccaccatcaccattagtga

SEQ ID NO: 174 - protein, 935 aa, Artificial Sequence
  Synthetic construct
EVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKITGAYSSSWYYDNWFDPWGQGTLVTVSSGGGGSGGGGSGGGGSGGSSYELTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVLGQGAQGGGSGGSAGDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGSTSHLVKCAEKEKTFCVNGGECFMVKDLSNPSRYLCKCPNEFTGDRCQNYVMASFYKHLGIEFMEAEELYQKGGSHHHHHH

SEQ ID NO: 175 - DNA, 2811 bp, Artificial Sequence
  Synthetic construct
gaggtgcagttggtcgaatcaggaggaggtttagtgcagcccggtggatcacttaggctgagttgctccgcatctggtttcactttctcttcctatgccatgcattgggtacgtcaggcaccggggaaaggactagaatacgtatcagccatatcttctaatggcggatcaacctactatgctgattcagttaaaggtagattcactatctcaagagataactccaaaaacacattgtaccttcaaatgagttcactgcgtgctgaggacacagctgtctattactgtgtaaagattactggagcctactctagttcctggtactacgacaattggtttgatccttggggccaaggaaccttagttacggtttccagtggcggtgggggatctggcggaggtgggagtggtggagggggttctggtggatcatcttatgaattgacccagcccccttctgtgtctgttagccctggacagactgccagcattacctgttccggcgataagctaggtgacaagtacgcttgctggtatcaacaaaagccagggcagtcaccagtgcttgtcatctaccaagattctaagaggccaagtggaataccagaacgattttctggctccaacagtggcaatacagctaccctgacaatttccggtacgcaagcaatggatgaggctgactactattgtcaggcctgggattcgtcaactgctgtgtttggtggtggtactaaactcactgtcttgggtcaaggggcccaaggaggtggatcaggaggctctgcaggtgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggttctacttcacatcttgtgaaatgcgccgaaaaagagaaaacattttgtgtgaatggtggagagtgctttatggttaaagatttgtctaaccctagtagatacctgtgcaaatgtcccaatgaattcacaggtgacagatgtcagaactatgttatggctagtttctacaaacatctgggcattgagttcatggaagccgaggaattgtatcaaaaaggtggatcccaccatcaccaccatcattagtga

SEQ ID NO: 176 - protein, 811 aa, Artificial Sequence
  Synthetic construct
EKLGKLQYSLDYDFQNNQLLVGIIQAAELPALDMGGTSDPYVKVFLLPDKKKKFETKVHRKTLNPVFNEQFTFKVPYSELGGKTLVMAVYDFDRFSKHDIIGEFKVPMNTVDFGHVTEEWRDLQSAEKGAQGGGSGGSAGDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGSTSHLVKCAEKEKTFCVNGGECFMVKDLSNPSRYLCKCPNEFTGDRCQNYVMASFYKHLGIEFMEAEELYQKGGSHHHHHH

SEQ ID NO: 177 - DNA, 2439 bp, Artificial Sequence
  Synthetic construct
gaaaagctgggaaagctgcaatacagtttggactacgatttccaaaacaatcagttgctcgtcggcattatccaggctgccgaattgccagctttagatatgggtggtacatcagatccctacgtcaaagtatttctactgcctgacaaaaagaaaaagtttgaaactaaggtgcacagaaaaacgcttaacccagttttcaacgagcagtttacattcaaagttccttattctgaacttggaggaaaaactctagtgatggccgtttatgatttcgataggttttctaagcatgacatcataggggagtttaaggtcccaatgaatactgttgatttcggtcatgtgaccgaggaatggcgtgaccttcaatccgcagagaaaggggcccaaggaggtggatcaggaggctctgcaggtgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggttctacttcacatcttgtgaaatgcgccgaaaaagagaaaacattttgtgtgaatggtggagagtgctttatggttaaagatttgtctaaccctagtagatacctgtgcaaatgtcccaatgaattcacaggtgacagatgtcagaactatgttatggctagtttctacaaacatctgggcattgagttcatggaagccgaggaattgtatcaaaaaggtggatcccaccatcaccaccatcattagtga

SEQ ID NO: 178 - protein, 1009 aa, Artificial Sequence
  Synthetic construct
EVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKITGAYSSSWYYDNWFDPWGQGTLVTVSSGGGGSGGGGSGGGGSGGSSYELTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVLGQGAQGGGSGGSAGDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKSGGSHHHHHH

SEQ ID NO: 179 - DNA, 3033 bp, Artificial Sequence
  Synthetic construct
gaggtgcagttggtcgaatcaggaggaggtttagtgcagcccggtggatcacttaggctgagttgctccgcatctggtttcactttctcttcctatgccatgcattgggtacgtcaggcaccggggaaaggactagaatacgtatcagccatatcttctaatggcggatcaacctactatgctgattcagttaaaggtagattcactatctcaagagataactccaaaaacacattgtaccttcaaatgagttcactgcgtgctgaggacacagctgtctattactgtgtaaagattactggagcctactctagttcctggtactacgacaattggtttgatccttggggccaaggaaccttagttacggtttccagtggcggtgggggatctggcggaggtgggagtggtggagggggttctggtggatcatcttatgaattgacccagcccccttctgtgtctgttagccctggacagactgccagcattacctgttccggcgataagctaggtgacaagtacgcttgctggtatcaacaaaagccagggcagtcaccagtgcttgtcatctaccaagattctaagaggccaagtggaataccagaacgattttctggctccaacagtggcaatacagctaccctgacaatttccggtacgcaagcaatggatgaggctgactactattgtcaggcctgggattcgtcaactgctgtgtttggtggtggtactaaactcactgtcttgggtcaaggggcccaaggaggtggatcaggaggctctgcaggtgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtcccgccttgccagaggatggcggttctggagcttttcctccaggtcacttcaaagatccaaaaagattgtattgcaaaaacggtgggtttttccttcgaatacatcctgacggtagagttgacggggtaagagaaaagagtgacccacatatcaagctacagttacaagccgaggaaagaggagttgtctcaatcaagggcgtttgtgctaacagatacttggctatgaaggaagatggtagactgcttgctagtaagtgtgtcactgatgaatgtttctttttcgaaagattggagtccaataactataacacgtacaggtcacgtaagtatacgagttggtacgtggctctgaaacgtacaggccagtataagttaggttcaaaaactggacccggacagaaagctatcttattcctacccatgtctgcaaagtctggcggtagtcaccatcaccatcatcattagtga

SEQ ID NO: 180 - protein, 885 aa, Artificial Sequence
  Synthetic construct
EKLGKLQYSLDYDFQNNQLLVGIIQAAELPALDMGGTSDPYVKVFLLPDKKKKFETKVHRKTLNPVFNEQFTFKVPYSELGGKTLVMAVYDFDRFSKHDIIGEFKVPMNTVDFGHVTEEWRDLQSAEKGAQGGGSGGSAGDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKSGGSHHHHHH

SEQ ID NO: 181 - DNA, 2661 bp, Artificial Sequence
  Synthetic construct
gaaaagctgggaaagctgcaatacagtttggactacgatttccaaaacaatcagttgctcgtcggcattatccaggctgccgaattgccagctttagatatgggtggtacatcagatccctacgtcaaagtatttctactgcctgacaaaaagaaaaagtttgaaactaaggtgcacagaaaaacgcttaacccagttttcaacgagcagtttacattcaaagttccttattctgaacttggaggaaaaactctagtgatggccgtttatgatttcgataggttttctaagcatgacatcataggggagtttaaggtcccaatgaatactgttgatttcggtcatgtgaccgaggaatggcgtgaccttcaatccgcagagaaaggggcccaaggaggtggatcaggaggctctgcaggtgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtcccgccttgccagaggatggcggttctggagcttttcctccaggtcacttcaaagatccaaaaagattgtattgcaaaaacggtgggtttttccttcgaatacatcctgacggtagagttgacggggtaagagaaaagagtgacccacatatcaagctacagttacaagccgaggaaagaggagttgtctcaatcaagggcgtttgtgctaacagatacttggctatgaaggaagatggtagactgcttgctagtaagtgtgtcactgatgaatgtttctttttcgaaagattggagtccaataactataacacgtacaggtcacgtaagtatacgagttggtacgtggctctgaaacgtacaggccagtataagttaggttcaaaaactggacccggacagaaagctatcttattcctacccatgtctgcaaagtctggcggtagtcaccatcaccatcatcattagtga

SEQ ID NO: 182 - protein, 18 aa, Artificial Sequence
  Synthetic construct
  PEPTIDE (1)..(18)
GGGGSGGGGSGGGGSGGS

SEQ ID NO: 183 - protein, 5 aa, Artificial Sequence
  Synthetic construct
  PEPTIDE (1)..(5)
GGGGS

SEQ ID NO: 184 - protein, 23 aa, Artificial Sequence
  Synthetic construct
  PEPTIDE (1)..(23)
GGGGSGGGGSGGGGSGGGGSGGS

SEQ ID NO: 185 - protein, 810 aa, Artificial Sequence; identical to SEQ ID NO: 152
  Synthetic construct

SEQ ID NO: 186 - DNA, 2823 bp, Artificial Sequence
  Synthetic construct
ggaccagagacattgtgtggagcagaactggtggacgctttacagtttgtgtgtggtgaccgtggtttctacttcaacaaacctacgggttacgggtctagttctcgtagagctccacagactgggattgtagatgaatgctgcttcagatcttgtgaccttcgacgtttagaaatgtactgtgcacctctaaaaccagccaaatctgctggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagggtcgactgggggagggagcggtggaggaaccggtcaagtccagctggtccagtcaggggcagaagtcaaaaagcctggtgaatctctgaaaatctcatgtaaaggctctggatatagttttacctcatattggatagcttgggttcgtcaaatgcctggtaaaggtttggagtacatgggtctaatctacccaggcgattcggatacaaagtactctccctcttttcaaggtcaagtcactatatccgtagataagtccgtatccaccgcatacctacaatggtcatctttgaagccttctgattctgccgtctacttctgcgctagggctgatgttggttattgtaccgataggacatgtgctaaggctcccgcttggctgggggtgtggggtcaaggcaccttggttacagtgtcctctggcggaggtggttcgtcaggaggcggttctggtggtggcggctcccaatcagtattgacccagcccccttctgtctccgctgctccagggcaaaaggtcaccatcagttgctctggtagttcctctaacattggtaacaattacgtcagctggtatcagcagttaccaggtactgcaccaaagctgttgatctacgaccacaccaacagacccgctggtgtcccagataggttttctggatcaaaatctggcacttcagctagtcttgctatctctggatttcgttccgaggatgaagccgattactactgcgcttcatgggattacactctatcaggctgggtgtttggcggaggcactaaactgacagtgcttggaggcgcaggcggatcaggtggtcaccaccatcatcaccattagtga

SEQ ID NO: 187 - DNA, 438 bp, Artificial Sequence
  Synthetic construct
cccgcgttgcccgaggacggaggttcaggggcctttccgccgggtcactttaaggacccgaaaaggctgtattgcaagaatggagggttcttccttcgtatccacccagacggccgagtcgatggagtgagggagaagagcgatccccatatcaaattgcagcttcaagcagaagaaaggggtgtagtgtcgatcaaaggagtttgtgcgaatcgttatctcgccatgaaagaggacgggcggttgttggcgtcgaaatgtgtgactgatgaatgcttcttctttgaaagacttgagagcaataactataacacataccgatctcgcaagtacacgtcctggtacgtcgccctcaaacgcacggggcagtacaaactggggagtaaaaccggccccggacaaaaggctattctctttctgcctatgtcggcaaagtca

SEQ ID NO: 188 - DNA, 438 bp, Artificial Sequence
  Synthetic construct
cccgccttgccagaggatggcggttctggagcttttcctccaggtcacttcaaagatccaaaaagattgtattgcaaaaacggtgggtttttccttcgaatacatcctgacggtagagttgacggggtaagagaaaagagtgacccacatatcaagctacagttacaagccgaggaaagaggagttgtctcaatcaagggcgtttgtgctaacagatacttggctatgaaggaagatggtagactgcttgctagtaagtgtgtcactgatgaatgtttctttttcgaaagattggagtccaataactataacacgtacaggtcacgtaagtatacgagttggtacgtggctctgaaacgtacaggccagtataagttaggttcaaaaactggacccggacagaaagctatcttattcctacccatgtctgcaaagtct

SEQ ID NO: 189 - DNA, 438 bp, Artificial Sequence
  Synthetic construct
ccagcactgccagaggatggcggatctggtgctttcccacctggacacttcaaggatcctaaaaggttatactgcaaaaacggtgggtttttccttagaattcaccctgatggcagagtcgacggtgttcgtgaaaagagtgacccacatatcaagttacagttacaagccgaagagcgaggagtagtttccatcaaaggcgtctgtgctaacagatatctagctatgaaggaggatggaagattgttggcctctaagtgtgttaccgacgaatgctttttctttgaaaggttggagtccaacaattacaatacttatcgttcacgaaagtatacgtcttggtacgtggctttgaagagaacaggacagtacaaattgggttccaaaactggtcctggtcaaaaagctatactttttctacccatgtctgcaaaatca

SEQ ID NO: 190 - DNA, 438 bp, Artificial Sequence
  Synthetic construct
ccagctttgcctgaggatggaggctctggtgcttttcctcctggtcatttcaaagacccaaaaagactgtattgcaaaaacggtgggtttttcctgaggattcatccagatgggagggtcgatggagttagagagaaatcagacccccacattaagcttcaactacaggctgaggaacgtggtgttgtctccatcaagggtgtttgtgcaaatcgatacttagctatgaaagaggacggcagattacttgccagtaagtgtgtaactgatgaatgtttctttttcgaaagactagaatccaataactacaatacttaccgttctcgtaagtatacatcatggtacgtggccttgaagagaacgggacaatacaaattgggttctaagaccggaccaggacagaaagcaatcttgtttttgcccatgtcagctaagagt

SEQ ID NO: 191 - DNA, 525 bp, Artificial Sequence
  Synthetic construct
caacgtaagaggagaaacactatccatgagttcaaaaagagtgccaagacaacccttataaagatagatccagcgttgaagatcaaaactaagaaagtaaataccgctgaccaatgcgctaataggtgtacgaggaataaaggtctaccatttacttgtaaagcatttgtttttgataaagcacgtaaacaatgcttgtggtttccatttaattctatgtcaagcggtgtgaaaaaggaatttgggcacgagttcgatctgtacgaaaacaaggattacattagaaactgcattataggtaagggtagatcctataaaggtacagtttcaattactaaatctggcattaaatgccagccctggagttccatgattccgcatgaacattcgttcttaccttctagctatcgtggaaaagatttacaggaaaactactgtagaaatccaagaggagaagaaggagggccttggtgtttcacatctaatcccgaagttagatatgaggtctgtgacatccctcaatgt

SEQ ID NO: 192 - DNA, 525 bp, Artificial Sequence
  Synthetic construct
cagcggaaaaggagaaacaccattcacgagtttaagaagtccgcgaagaccacactgattaagattgatcccgcccttaaaatcaagacaaagaaggtgaacacggctgaccagtgtgctaatcgctgcacaaggaataaaggactgccatttacttgtaaagcctttgtattcgataaggcacgcaagcagtgcctctggttccctttcaattctatgagcagtggtgttaagaaagagtttggccatgaattcgacttgtacgaaaacaaagattatatccggaactgcattatcgggaaaggccggtcttacaaaggcaccgtctccataaccaagagtggcatcaaatgtcaaccctggagctcaatgatcccacatgaacactccttcctcccaagttcataccggggcaaggacctgcaagagaactattgcagaaatccgcgaggggaagagggagggccttggtgtttcacttctaatcccgaggtgaggtatgaggtgtgcgacatacctcagtgc

SEQ ID NO: 193 - DNA, 525 bp, Artificial Sequence
  Synthetic construct
caacgtaaaagacgaaatacaattcatgagttcaaaaagtcagccaaaactacattgattaagattgatcccgctctgaagataaagaccaaaaaggtcaacacagctgaccagtgcgccaacaggtgtaccaggaataagggactaccttttacttgtaaagctttcgtattcgacaaagcaaggaagcaatgtctgtggttcccctttaactctatgtcatctggggtgaaaaaggaatttggccatgaatttgatttgtatgaaaacaaagattacattagaaattgcattatcggcaagggaagatcatacaaaggtacggtttctattactaagtctggaatcaagtgccaaccatggtcatccatgatccctcacgagcacagtttccttccaagttcctaccgtggtaaagacttacaagagaactattgccgaaatcctagaggtgaagagggaggtccatggtgttttacctccaaccctgaagttagatatgaagtctgtgatatacctcagtgt

SEQ ID NO: 194 - DNA, 525 bp, Artificial Sequence
  Synthetic construct
caacgtaagcgtcgaaacactatccatgagttcaaaaagtctgcaaaaactactttgataaagatagacccagctttgaagataaagacgaaaaaggtcaatactgccgaccagtgtgctaatcgatgtactagaaacaagggcttaccctttacttgtaaggcttttgttttcgacaaagcaaggaagcaatgtttatggttccccttcaattcaatgagttctggtgtgaaaaaggaatttggtcatgaatttgatttgtacgagaacaaagattacattagaaactgcattatcggcaaaggaagatcttacaaggggacggtgtctataacaaagagtggcataaagtgtcaaccatggtctagtatgattccacatgagcactctttccttccctcctcctatcgaggaaaagacctacaagagaactattgtcgaaaccctagaggagaagagggaggcccttggtgctttacgagtaaccctgaggttagatacgaagtttgtgacattccacaatgc

SEQ ID NO: 195 - DNA, 210 bp, Artificial Sequence
  Synthetic construct
ggcccagaaacactttgtggagccgaactggtggatgctctccaattcgtttgcggcgaccgcggattctactttaacaagcccaccggttacgggtcttcaagccggagggccccgcagactggcatcgtcgacgagtgctgttttagaagctgcgatctgcgacggttggagatgtattgtgcacctctgaagcccgcgaaaagtgct

SEQ ID NO: 196 - DNA, 210 bp, Artificial Sequence
  Synthetic construct
ggacctgaaaccttatgtggagctgaacttgtggatgctctacaatttgtttgtggcgatagagggttctacttcaacaaacccactggatatggtagttcctcaagacgagctcctcagacaggtattgtcgacgagtgttgttttaggtcttgcgacttgcgtagactggagatgtactgcgcaccattgaagccagcaaagtctgcc

SEQ ID NO: 197 - DNA, 210 bp, Artificial Sequence
  Synthetic construct
ggaccagagacattgtgtggagcagaactggtggacgctttacagtttgtgtgtggtgaccgtggtttctacttcaacaaacctacgggttacgggtctagttctcgtagagctccacagactgggattgtagatgaatgctgcttcagatcttgtgaccttcgacgtttagaaatgtactgtgcacctctaaaaccagccaaatctgct

SEQ ID NO: 198 - DNA, 666 bp, Artificial Sequence
  Synthetic construct
tcggggaagaaacccgaatccgctgccggttcgcaatcgcccgccttgcctccgcgtttgaaggagatgaaaagccaggagagcgcagcaggaagcaaactcgtcctccggtgtgaaacctcgagcgaatacagttccctgaggtttaagtggttcaagaatgggaatgagcttaatcggaagaacaaaccgcaaaacatcaaaatccagaagaaaccggggaaatccgaactccgcattaacaaagcgtcgcttgccgatagcggggagtacatgtgcaaagtgatctcgaaactgggcaatgattcggcgtctgcgaacattacaatcgtagaatccaatgagattatcacggggatgcccgcgtcaactgagggagcatatgtatcgtccgaatccccaattagaatctccgtgtcgacagagggtgcgaacacgtcgtcatcgacttcaacatcaacgacgggcaccagtcaccttgtcaaatgcgccgagaaggaaaagacgttttgcgtgaatggaggagaatgcttcatggtcaaggacttgtcgaacccttcacgatatctgtgtaagtgtcaacccggtttcaccggagctcgatgtacagaaaatgttccgatgaaagtgcaaaatcaggagaaagcggaagagctctaccagaaa

SEQ ID NO: 199 - DNA, 195 bp, Artificial Sequence
  Synthetic construct
agccaccttgtgaaatgtgcggagaaagaaaagacattctgtgttaatggcggggagtgcttcatggtaaaagacctgtcgaatccgtcaagatatctctgcaaatgccagcccggttttacgggagcccgatgtaccgagaacgtgcctatgaaagtccaaaaccaggaaaaggcagaagaattgtaccaaaag

SEQ ID NO: 200 - DNA, 213 bp, Artificial Sequence
  Synthetic construct
acttcacatcttgtgaaatgcgccgaaaaagagaaaacattttgtgtgaatggtggagagtgctttatggttaaagatttgtctaaccctagtagatacctgtgcaaatgtcccaatgaattcacaggtgacagatgtcagaactatgttatggctagtttctacaaacatctgggcattgagttcatggaagccgaggaattgtatcaaaaa

SEQ ID NO: 201 - DNA, 213 bp, Artificial Sequence
  Synthetic construct
acttcccatttggtgaagtgtgcagaaaaggaaaagacattttgtgtaaacggtggggagtgctttatggttaaggacttgagtaatccttcaagatatctttgcaaatgtccaaatgagtttaccggagatcgttgtcaaaactacgtcatggcctccttctacaaacacttaggtattgaattcatggaagctgaggaactgtatcagaaa

SEQ ID NO: 202 - DNA, 213 bp, Artificial Sequence
  Synthetic construct
acttctcatttggtgaaatgcgccgagaaggagaaaacgttctgcgtgaacggtggtgaatgctttatggtcaaagatctgtctaacccttctcgatatctttgtaagtgtcccaacgagtttactggtgatcgatgtcagaactacgttatggcttccttttacaaacacttgggtatagaattcatggaggccgaggagttgtaccaaaaa

SEQ ID NO: 203 - DNA, 1944 bp, Artificial Sequence
  Synthetic construct
aacaatcactatgacaagattctggcacatagccgaatcaggggcagggaccagggacccaatgtatgcgctttacaacaaattctgggcaccaagaaaaagtatttctctacatgcaaaaactggtacaaaaagtcaatttgcggtcaaaagaccacggttctgtacgagtgttgtccaggctatatgagaatggagggtatgaagggatgtccagcagttttgccaatcgaccacgtgtatgggactctcggcattgttggagctactaccactcagaggtactctgatgcttccaagctgagggaggaaattgagggtaaaggctcttttacctacttcgctcctagtaacgaggcatgggataatctggacagcgatatccgtagggggttggaatctaatgttaatgtcgaattgctgaatgccttgcactcccacatgattaacaaacgaatgctaacaaaagatttgaaaaacggaatgattatcccttcaatgtacaacaacttaggtcttttcattaaccattacccgaatggtgtggtcactgtcaattgtgctagaatcatccacggtaatcaaatcgctacaaacggggtagtccatgtaatcgatagagtgctaacgcagataggaacgtccattcaagatttcattgaagccgaggacgatctgtctagttttagagctgccgcaataacgtcagacattttggaggctttaggaagggatggccactttaccttgtttgctccaactaatgaagcatttgagaagttgcctagaggtgttttggaaaggataatgggtgacaaagtcgccagtgaggccttaatgaaataccatatactaaacacgctgcaatgtagtgaatccatcatgggaggggcagtttttgaaacactggaaggaaacactattgaaatcggatgcgatggtgattccattacagttaacggaatcaaaatggtcaacaaaaaggacattgttaccaacaacggtgttattcatttgattgatcaggtgcttattccagattccgccaagcaggtaatagaacttgctggaaagcagcaaactacttttactgacctggttgcccaactaggcttggcctcggctcttagacccgatggtgaatacacattacttgctcctgtcaacaatgcattttccgacgataccttgagtatggaccagagactactgaaactgatactgcaaaaccatatcttaaaggttaaagtgggattgaatgagttgtacaatggacaaatcttggagactattggcggcaaacagttacgtgtctttgtgtatcgaaccgcagtgtgtatagagaatagttgtatggaaaagggttcaaagcagggtagaaatggagctatccacatattcagagagattatcaaaccagctgagaaatccctccacgaaaagctgaaacaggacaaacgttttagtaccttcctttctctattggaggcagctgacttgaaggaacttctcactcaacccggagattggacacttttcgtcccaacaaatgatgccttcaagggaatgacctcagaggaaaaggaaatacttatcagggacaaaaacgcattacagaacattatcttataccatttgacaccaggggttttcattggtaaaggttttgaacccggtgtgactaacattctaaagactactcaaggatctaagatctttttgaaagaggtcaatgacactttgttggtgaatgaacttaagtctaaagagtccgatatcatgacaacaaatggtgtaatccatgtagttgataagttactttatcctgccgacacaccagttgggaacgatcaactgcttgagattttgaacaaactaatcaagtacattcagattaagttcgttcgtggatctaccttcaaggaaattcctgttactgtttat

SEQ ID NO: 204 - DNA, 342 bp, Artificial Sequence
  Synthetic construct
caggctaaacacaagcagcgaaagagattgaagtctagttgcaaaaggcacccactgtacgttgatttctccgatgtggggtggaatgattggattgttgctccacctggttaccacgccttctattgtcatggcgagtgtccctttcctctagccgaccatctgaactcaactaaccatgcaatagtgcaaaccctagttaactccgtcaattctaagattcccaaggcttgttgtgtaccaacagaacttagtgcaatctctatgctttacttagacgaaaatgagaaggtcgttttgaaaaactatcaagacatggtcgtagaaggatgcggttgcaga

SEQ ID NO: 205 - DNA, 669 bp, Artificial Sequence
  Synthetic construct
aagtccagttgcaaaagacatccactttatgttgacttttcagacgttggttggaatgattggatagtggctcctcctggctatcacgcattctattgtcatggtgaatgcccctttccattagccgatcacttgaactctactaatcatgcaatagttcagacgctggtaaactccgtgaattctaagattcccaaggcttgttgtgttcctaccgaactttctgccatttcgatgctatatctggacgaaaacgagaaagtcgtgttgaaaaactatcaagacatggttgttgagggttgtggatgcaggggtggtggaagtgggggaggctcaggcggagggtctggtggcgggaagtctagctgcaagcgacaccctttgtacgtcgatttctccgacgtgggttggaacgattggatcgtagctccgccaggttaccatgcattctactgccacggcgagtgcccttttccccttgctgatcatctgaattccacaaatcatgctattgtgcagaccctagttaactcagttaactctaagatccctaaagcctgttgtgtcccaactgaactcagtgctatttctatgttatacttagatgaaaatgaaaaggtcgtcttgaaaaactaccaagatatggtagtagagggatgcggatgtcgt

SEQ ID NO: 206 - DNA, 618 bp, Artificial Sequence
  Synthetic construct
gctccgatggcagagggtggaggtcaaaatcatcatgaggtggtgaagtttatggatgtatatcaacgatcctactgtcaccccatcgaaacattggtcgatatcttccaagaatatcccgacgaaattgaatacatctttaagccctcgtgtgtacctcttatgaggtgtggaggttgctgcaatgatgaaggcctggaatgtgtcccgacggaagagtcaaacattacaatgcagattatgcgaatcaaaccccaccaagggcagcacatcggagagatgtcgtttctccagcacaacaaatgtgagtgcagacccaagaaagatagagcgaggcaggaaaagaaaagcgtgcgcggaaaagggaaaggacaaaagcgtaaacggaagaaatcccggtataagtcgtggagtgtgtacgttggggccagatgttgtttgatgccttggtcgctgcctgggccgcacccatgcgggccatgctctgagaggcgtaaacatctcttcgtccaagacccgcagacgtgcaaatgctcatgcaagaatactgacagccgttgtaaagcgcggcagcttgagcttaacgagaggacctgccgatgtgacaaaccgcgccgc

SEQ ID NO: 207 - DNA, 1290 bp, Artificial Sequence
  Synthetic construct
gcgccgatggctgagggcggagggcagaaccatcacgaggtcgtgaaattcatggacgtgtaccagaggagttattgtcatcctatcgaaacacttgtcgacattttccaagagtaccccgatgagatcgagtatatctttaagccctcgtgcgtgccacttatgcgctgcggaggctgttgcaatgatgaaggcctggagtgtgtaccaactgaagagtcaaacattaccatgcagatcatgagaatcaaaccgcaccaagggcaacacatcggggagatgtcattcttgcaacacaacaaatgcgaatgccgaccgaagaaagaccgtgcacgacaggagaagaaatcggtccggggaaaagggaaagggcagaaaaggaaaaggaagaaatctcgctataagtcgtggtccgtctacgtgggtgcgcgttgttgtttgatgccgtggagcctgccgggaccccatccttgtgggccgtgttctgaacggcgaaaacatctctttgtacaagatccgcagacttgcaaatgttcgtgcaagaatactgactccagatgtaaagccaggcaattggagctcaatgagaggacgtgccgatgtgacaaacccagaagggcatcaacgggtggaggtggatcaggtggcggcggttctggtggaggaggatccgccccgatggcggagggaggtggacaaaatcaccatgaagtggtaaagtttatggacgtttatcagagatcgtattgtcaccccattgaaacactggtagatatctttcaagaataccccgacgaaattgaatacattttcaaacctagctgtgtgccactgatgcggtgcggtgggtgctgcaacgacgaagggctcgagtgtgtgccaacggaggagtccaatatcacaatgcaaatcatgcgcatcaagccccatcaaggacagcacattggggaaatgtcgtttctccagcacaataagtgtgaatgtcgccccaagaaagatagagcgcgacaggaaaagaaaagcgtgcgagggaaggggaagggacaaaagaggaaacgcaagaaatcgagatacaaaagttggtccgtttacgtcggagcccgttgctgccttatgccgtggtcactgcccggtcctcatccctgtggaccttgcagcgagcgccggaaacaccttttcgtccaagatcctcagacgtgcaagtgctcgtgtaagaataccgattcacggtgcaaagcgcgtcagttggaactcaacgaaagaacatgtagatgcgataaaccacgtcga

SEQ ID NO: 208 - DNA, 564 bp, Artificial Sequence
  Synthetic construct
atgagtcctttgcttagaaggttgttactggccgcactgcttcaacttgcaccagctcaagccccagtctctcaacctgacgctcccggtcatcagagaaaggtggtatcatggattgatgtgtatactcgtgctacatgccaaccccgtgaggttgttgtacctttgacagtcgaattgatgggaaccgttgccaagcagttagttccttcctgtgtcacagtgcagagatgtggaggatgttgtccagatgatggtttggagtgtgtacctactggccaacatcaggttagaatgcagatcttgatgatacgttacccatcaagtcaactaggtgaaatgtctttggaggaacactcccagtgcgaatgcagacccaaaaagaaagattctgctgttaaaccagactctccaagaccattatgtcccagatgcacgcaacaccatcaaagaccagatccaaggacttgtagacgtagatgcaggaggcgatcctttttgcgatgccaaggtagaggcctagagctgaatcctgacacctgtcgatgtcgaaagttaagacgt

SEQ ID NO: 209 - DNA, 564 bp, Artificial Sequence
  Synthetic construct
atgtctcctttgctgagaaggttactattggctgcattgttgcagttagccccagcccaagctcccgtttcccaaccagatgcacctggtcatcaacgaaaggtggtttcctggatcgatgtctacacgagagctacctgtcaaccaagggaagttgtagttcccttaactgtggagcttatgggtacagtagccaagcaattagttccctcatgtgtcactgttcagcgatgtggagggtgttgtcctgacgacggcctagagtgcgtcccaacaggacagcaccaagtgagaatgcaaattctgatgatacgatatcctagttctcagttgggtgaaatgagtttggaggagcattctcaatgcgaatgtagacccaaaaagaaagattccgctgtcaaaccagactctcctagaccactatgcccaagatgcactcaacaccaccagcgtcctgatcctagaacttgtaggcgtagatgtcgtagaagatcattccttagatgtcagggaagaggtcttgaattgaatccagacacctgccgatgtcgtaagctgcgtagg

SEQ ID NO: 210 - DNA, 393 bp, Artificial Sequence
  Synthetic construct
atgagtcctttgttgagaaggttgctattagctgcattgttacagttagctcctgctcaggccccagtttctcagccagacgcccctggtcatcaacgtaaggttgtgtcttggattgacgtatacacgagagcaacatgccaaccaagggaagtcgttgttccccttactgttgagttgatggggactgtggctaagcagctggtcccttcatgtgtcaccgtacagagatgtggaggttgttgcccagacgatggactagaatgtgttccaacaggacaacatcaggtgagaatgcaaatactgatgatcagatatccatcttcacaacttggcgaaatgtccctggaagagcactctcaatgcgagtgtcgacccaaaaagaaagatagt

SEQ ID NO: 211 - DNA, 393 bp, Artificial Sequence
  Synthetic construct
atgagtcctttgctaagacgtttacttttggctgccttattgcagctggcaccagcccaagcaccagtgtcacagccagatgctcccggtcaccagagaaaagtggttagttggattgatgtttacacgagggctacatgccaacctagagaagtagttgtccctctgacagttgaactaatggggaccgttgctaagcaattggtgccttcctgtgtcactgttcagcgatgcggaggatgttgtccagacgacggtctggaatgcgtaccaactggccaacatcaagtcagaatgcagatcttgatgataagatatccatcttcccaattaggagaaatgtcacttgaggaacattctcaatgtgagtgtaggcccaaaaagaaggattct

SEQ ID NO: 212 - DNA, 1755 bp, Artificial Sequence
  Synthetic construct
gacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgaccgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctg

SEQ ID NO: 213 - DNA, 1755 bp, Artificial Sequence
  Synthetic construct
gatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtctt

SEQ ID NO: 214 - DNA, 1755 bp, Artificial Sequence
  Synthetic construct
gacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggacta

SEQ ID NO: 215 - DNA, 615 bp, Artificial Sequence
  Synthetic construct
ggtgaggaaccacagaatctgatcaaacagaactgcgaactattcgaacaactgggcgagtacaagtttcaaaatgccctgcttgtgaggtataccaaaaaggttcctcaagtgtccactcccaccttagttgaggtatctagaaatcttggaaaggtgggttccaaatgttgcaaacatccagaagctaaaaggatgccttgtgccgaggactatttgtcagtcgtgttgaaccagctttgtgtcttacacgaaaagacacctgttagtgacagagttacgaaatgctgtacagagtcacttgtaaaccgtagaccatgtttttctgctttggaagttgacgagacttacgtaccaaaagagttccaagccgaaacttttacgtttcatgccgacatttgcactttgtctgagaaggaacgacagatcaaaaagcaaaccgctctggttgaactggttaagcacaagcccaaagctacaaaggaacagctaaaggcagtcatggatgatttcgcagcttttgtcgagaaatgttgtaaggctgatgataaggagacatgcttcgctgaagagggcaaaaagttggtcgcagctagtcaggctgctctaggtttg

SEQ ID NO: 216 - DNA, 1773 bp, Artificial Sequence
  Synthetic construct
agaaccttgcatagaaacgaatatggcatagcatccattttggactcttatcagtgtaccgctgaaatcagtctggctgatctagccaccatctttttcgcccagtttgtacaagaggctacgtataaggaggtttccaagatggttaaggatgcattaactgcaattgaaaaaccaacaggtgatgaacaatctagcggttgtcttgaaaatcaacttccagcctttttggaggagctttgtcacgaaaaggaaatccttgagaagtacgggcactccgattgttgctcacaatccgaggaggggcgacataactgttttctggctcacaaaaagcctacacccgccagtattcccctttttcaagtcccagaaccagtgacctcatgtgaagcctatgaggaggatagagaaacctttatgaataagttcatatacgagatcgccaggaggcaccctttcctatacgctccaacaatcttgctatgggcagctcgatatgacaagatcattccctcttgctgtaaagctgaaaatgctgtagagtgcttccaaaccaaggctgccactgttaccaaggaactgcgagaatctagtcttttgaaccagcacgcttgcgctgtaatgaaaaactttggaaccagaacatttcaagccattactgtcacaaaactgtctcaaaagttcactaaagtacagtttactgaaattcagaaattggtgttggacgtcgcccatgtccatgaacattgttgtaggggagatgtactggattgcctccaagacggcgagaagattatgtcctacatttgctcacagcaggatacgttgtccaacaagatcaccgaatgttgcaaactcactacattggaaagaggtcagtgtatcattcacgctgaaaacgacgagaaaccagaaggactatcacctaatctaaaccgattccttggtgatagagacttcaatcaattctcttctggcgagaaaaacatattccttgcttcatttgttcacgagtactcccgtcgtcatccacaactggccgttagtgtgatcttgagagttgccaaaggctaccaggaactgctggaaaagtgttttcagactgagaatcctctggagtgccaagataagggtgaggaagagttacagaagtacattcaagagtcacaagcattagcaaaaaggtcatgcggtctgtttcagaagttgggagaatactatcttcaaaatgccttcctggtcgcttacacgaaaaaggctcctcaactaacgtccagtgagcttatggctattacaaggaaaatggcagccaccgctgctacatgttgccaactgtccgaagataagttattggcatgtggtgaaggagccgctgacataatcattggtcatctgtgcattagacatgaaatgactccggtcaatcccggagtgggtcagtgttgtacttcatcttatgctaaccgtaggccttgtttctcttcgctggtggttgacgaaacctatgttccaccagctttctctgatgacaagttcatctttcacaaagacttatgtcaggcacaaggagttgcattgcaaactatgaaacaggaattccttatcaatctagtgaagcagaaaccacagattactgaagagcagttagaagcagtgattgctgatttctctggtttgctagaaaagtgctgccagggccaggagcaggaagtgtgctttgcagaggaaggacagaagttaatcagtaagacaagagctgctcttggagtg

SEQ ID NO: 217 - DNA, 321 bp, Artificial Sequence
  Synthetic construct
gatatacagatgacgcagtctccatcatccctgtctgcttcagttggtgaccgagtaactattacatgtagagccagtcagtggataggttcacaattgtcctggtatcaacagaagcccggaaaggctcctaaacttctaatcatgtggagatcctctttacagtctggagtcccatctaggttctccggcagtggctccggtactgacttcaccttgaccattagttcactgcaaccagaagattttgccacctactattgcgcacagggtgctgctcttcctcgtacttttggtcaaggcacaaaagtggagattaag

SEQ ID NO: 218 - DNA, 1446 bp, Artificial Sequence
  Synthetic construct
gaaccaaaatcaagcgacaaaacccacacctgccctccgtgtccagccccagagttactaggtggtccatccgtttttctcttcccaccaaagccaaaagataccctgatgattagccgaacgcctgaagtcacatgtgttgtcgttgacgtttcccacgaggaccctgaggtaaagtttaactggtacgtagacggcgtagaagtccacaatgctaaaacaaagccaagggaagagcaatacaactctacttatagggtcgtgagtgtcttaaccgtgctacaccaggactggttgaatggtaaagagtacaagtgcaaggtgtctaacaaagcactacctgccccaatagaaaagacaatcagtaaggcaaaaggtcagcccagagaaccccaagtgtatactctgcccccatctagagatgagcttacgaaaaaccaggtttctctcacgtgtctggttaaaggattctatccttctgatatcgccgttgagtgggagtcgaatggacagcccgaaaacaattacaaaactaccccaccagtccttgattccgacggctcctttttcctttactctaagttgacagttgacaaatccagatggcaacaaggtaatgtgttctcttgttcagtgatgcatgaggctttgcataaccactatacccagaaatcccttagtttatcccctggtggaggtgggggtagtggcggtggtggatcaggaggtggtggctcagggggaggcggttcggaacccaagtccagtgataagactcatacttgtccaccctgtcctgcccctgagcttttgggaggtccgagtgtctttttgtttccgcctaagcctaaagacacccttatgatttcaaggacaccagaggttacatgcgtggtcgtcgatgtctctcacgaggaccctgaggtgaaattcaattggtacgtggatggcgtggaagttcataacgctaagacgaaacccagagaggaacaatatcagagtacttatcgtgtggtttccgttctgactgtactgcatcaggattggctgaatggaaaggagtacaaatgtaaggtttctaacaaggctctacctgctccaattgaaaagactatatctaaggctaagggacaaccaagggaacctcaagtatacacattgcctcctagtagagatgaattgaccaaaaaccaagtatctttaacctgcctagttaaaggcttctacccatccgacattgctgtagaatgggagtcaaatgggcagccagaaaacaactataagactacacccccagtgttggattctgacggctcctttttcctatactctaaactgactgtagataagtcacgttggcaacagggaaatgtcttttcatgctctgttatgcatgaagcattgcacaatcactacactcagaaaagtctgtcactttcacctggt

SEQ ID NO: 219 - DNA, 1374 bp, Artificial Sequence
  Synthetic construct
ctagaaaggggtcgagactatgagaaaaacaaagtgtgtaaagagtttagtcatcttgggaaggaggacttcacaagtctttctctggtgttatacagtaggaagtttccatctggcacatttgaacaagtctcacagttggtgaaggaagttgtgtctttaactgaagcctgttgtgccgagggtgccgatccagattgctatgacaccagaaccagtgctttatccgctaagtcttgtgaaagtaatagtccatttccagtccatcccggtactgccgaatgctgtacaaaagagggattggagagaaagttgtgtatggctgctctaaagcatcagcctcaagagtttccaacgtacgtagaacccacgaatgacgagatttgtgaggctttccgtaaagaccctaaagagtatgctaatcagttcatgtgggaatactcaacgaattacggtcaagctcccttgagcctgttagtttcctataccaaatcatatctgtcaatggtcggatcatgttgtacctctgcatcacctacagtttgctttctaaaggaaagattacagcttaagcacttgtctttgttgactactctatctaaccgtgtttgttctcaatatgcagcctatggtgagaaaaagtccaggctatccaatcttatcaaactggcacaaaaggtccctacggccgatcttgaggatgttctgccactggccgaagatatcaccaacatcctttccaagtgctgtgaatccgcttcagaagattgtatggcaaaggagttgccagagcacactgtgaaactatgcgacactctaagtaccaaaaactcaaagttcgaggactgctgccaggaaaagaccgctatggacgtttttgtttgcacttactttatgcctgccgcacagctgcctgaactgcctgatgtggagttaccaactaacaaagacgtgtgcgatcccggcaataccaaagtcatggacaagtacactttcgaattgtccagaaggacacacctccctgaggttttcctctctaaggtattggaacccaccctgaagtctttaggcgagtgttgcgatgttgaggactcgacaacatgcttcaatgcaaagggacctctattgaaaaaggagctttcctctttcattgataaaggccaggaactttgtgcagattactcagaaaacacattcactgaatacaaaaagaagctggctgagagattgaaagctaagctgccagacgctactccaaaggaactagctaaactggtcaataagcgaagtgatttcgcctctaactgttgctccataaactctccgcctctttactgcgattctgagatcgatgccgaattgaaaaacattttg

SEQ ID NO: 220 - DNA, 732 bp, Artificial Sequence
  Synthetic construct
cttgaatcaggaggcgggcttgtgcaaccagggggatccttgagactttcgtgcgccggaagtggtttcacgttttcgtcgtatgcgatgagctgggtgagacaggcccctggtaaaggacttgagtgggtatcgtccatttccgggtctggaggatctacatactacgccgattctgttaagggccgctttaccatctcccgcgacaacagcaaaaagacgctgtacctccaaatgaactcgttgcgggcagaagatacggcggtgtattactgcgcaagaaaacgcgggagaacgacagtgagttggggactggtatactttgactactgggggcagggtactgtggtaacggtttcttcgggaggtggcgggtcagggggtgggggatcgggagggggaggtagcggaggttctgagctgacgcaatcgcccggtacattgagtctctcgcctggcgagcgagcaacgctgtcatgtagagcgagccactcagtttcgagggcgtatctggcgtggtaccagcagaaacccggtcaggcccccagacttttgatctatgggacttcaagtcgagcgaccgggatccccgataggttttcggggtccggctcgggaacggactttaccctcaccatttcgaggctggagccagaagatttcgccgtgtactactgccaacagtacggcgggagcccgtggtttggacagggaactaaggtggaacttaaa

SEQ ID NO: 221 - DNA, 732 bp, Artificial Sequence
  Synthetic construct
ttggagagtgggggtggcttggttcaacccggtggatctttgagattgtcatgtgccggttctggttttacctttagttcctatgctatgtcttgggtccgtcaagccccaggcaaaggacttgaatgggtatcatcaatctccgggtcaggtggtagtacgtattacgcagattctgtgaaaggtaggtttaccatttccagagataactccaaaaagacattgtacttgcaaatgaatagtctgagagctgaggatactgccgtctattactgtgcccgaaaaagaggcagaactacagttagttggggtcttgtctactttgactactggggtcaggggacggtcgttaccgtatcttccggtggagggggttctggaggaggaggatctggtggtggtggaagtggaggttctgaattgacccaatctcctggtactctgtctctaagtccaggagaacgagccacgttgtcatgtagggcctcacattcagtttcaagagcttatcttgcctggtatcaacagaaacctggacaggccccacgtttgttgatatacggcaccagttccagggctacaggaataccagataggttttctggatctggctcaggaacggatttcactttgacaatttcaagactagagccagaggactttgccgtatactactgtcaacaatatggaggatcaccttggttcggacagggtactaaagttgaacttaaa

SEQ ID NO: 222 - DNA, 747 bp, Artificial Sequence
  Synthetic construct
ctggagagcgggggtggcctggtccaaccaggcggatctctgagactcagttgtgcagggagcggatttaccttcagctcctatgctatgtcttgggtgcgccaggcacccgggaaggggctggagtgggtcagtagcatcagtggcagcggcggaagcacctactatgctgatagtgttaagggaaggttcacgatcagccgcgacaattccaaaaagaccctttatctccaaatgaactcactgcgcgccgaagatacggccgtctactactgtgcacggaaaagaggcagaaccaccgtgtcctggggcctggtttacttcgattactggggtcagggcaccgtagtgactgtgagcagcggaggcgggggttctggtggcggaggatcaggcggcggaggaagtggtgggggcggctccggtgggagcgagctgactcagtctccgggaactcttagtttgtctcccggcgagcgagcgacactctcttgccgagcgtcccactccgtgtctcgagcctatctggcctggtatcaacagaaacctgggcaggcaccccggctgctgatttacgggacttcctcacgggctacaggtatccctgacaggttttccggcagtggctccgggacagacttcaccctgactatatcaaggctggaaccagaagactttgccgtgtattactgccagcagtacggagggtcaccttggttcgggcagggaacaaaggtggagcttaag

SEQ ID NO: 223 - DNA, 756 bp, Artificial Sequence
  Synthetic construct
gaggtgcagttggtcgaatcaggaggaggtttagtgcagcccggtggatcacttaggctgagttgctccgcatctggtttcactttctcttcctatgccatgcattgggtacgtcaggcaccggggaaaggactagaatacgtatcagccatatcttctaatggcggatcaacctactatgctgattcagttaaaggtagattcactatctcaagagataactccaaaaacacattgtaccttcaaatgagttcactgcgtgctgaggacacagctgtctattactgtgtaaagattactggagcctactctagttcctggtactacgacaattggtttgatccttggggccaaggaaccttagttacggtttccagtggcggtgggggatctggcggaggtgggagtggtggagggggttctggtggatcatcttatgaattgacccagcccccttctgtgtctgttagccctggacagactgccagcattacctgttccggcgataagctaggtgacaagtacgcttgctggtatcaacaaaagccagggcagtcaccagtgcttgtcatctaccaagattctaagaggccaagtggaataccagaacgattttctggctccaacagtggcaatacagctaccctgacaatttccggtacgcaagcaatggatgaggctgactactattgtcaggcctgggattcgtcaactgctgtgtttggtggtggtactaaactcactgtcttgggtcaa

SEQ ID NO: 224 - DNA, 735 bp, Artificial Sequence
  Synthetic construct
gaagtgcagcttcagcagagcgggcctgaactggttaaaccaggtgccagcatgaagatttcctgtaaggcttctgggtacagtttcaccgggtacaccatgaaatgggtgaagcaaagccacggaaagaaccttgagtggattggattgatcaacccctataatgggggaactagctataaccagaagttcaaggggaaggctactctgacggtggacaagtcatcaagcaccgcatatatggagctcctctccctgacttctgacgacagcgcagtatactattgcgccagagagggggactacgatggggctatggactactggggccaggggacaagcgtcactgtctccggtggaggtggctccggtggcggcggaagcggcggtggaggctcagggggcggaggctctggcggctcagacatccagatgacccaatccccgtcttccctctctgcctccttgggcgggaaggtgacaatcacgtgcaaaagttcccaggatatcaataaatacatcgcctggtaccaacacaaaccaggcaaaggccctggactgctgatacattataccagtaccttgcagcccggcataccctctcggttcagcggcagtggatcaggtcgcgattacagttttagtatttcaaatctggatcctgagaatattgcagcgtattactgtctccagtatgataacctgtacacatttggagggggaacaaggctggaa

SEQ ID NO: 225 - DNA, 957 bp, Artificial Sequence
  Synthetic construct
gcgcaagtcttgcgtggtacggtgacagacttcccaggcttcgatgaaagagcggacgcggaaacacttcgaaaggcgatgaaagggctcggtactgacgaagagtccattttgacccttcttacgagcaggtcaaacgctcagaggcaagaaatctctgcagcctttaagacactctttggacgtgaccttcttgatgacctcaaatctgagctgacgggaaagtttgagaaactcatcgtagctttgatgaagcccagccgattgtatgatgcttacgaactgaaacacgccctgaaaggagcgggaacgaacgagaaagttttgactgagatcatcgcatcgcggaccccggaagagctcagagccatcaaacaagtctacgaggaggagtacggatcgtcattggaagatgacgtggtgggggatacgtcgggttactaccaacgaatgcttgtcgtgcttttgcaggcaaatcgcgacccggatgcggggatcgacgaggcccaagtggagcaagatgcgcaagcactcttccaggccggtgaactcaaatgggggaccgatgaagagaagtttatcaccatctttggcacgaggagtgtaagtcatctgcgtaaagtattcgataagtatatgacaatctcagggtttcagattgaggagacaattgacagggaaacctccggtaacttggagcagctcttgcttgccgtcgtcaagtccattcgctcgatccctgcgtatctggctgaaacactgtattacgccatgaaaggggcaggcactgatgaccacaccttgattagagttatggtgtcgcgatcagaaattgacttgttcaatatccggaaagagttccggaagaatttcgcaacgagcctctatagcatgatcaaaggggacacttcgggagattacaagaaagcgttgctccttctttgtggagaggatgac

SEQ ID NO: 226 - DNA, 957 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgagttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtgacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagagacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtgatacttcaggtgattacaaaaaggctctgcttttgctgtgtggcgaggacgat

SEQ ID NO: 227 - DNA, 957 bp, Artificial Sequence
  Synthetic construct
gctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagaactgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtgatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggaaacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtgatacttccggtgattacaaaaaggctttgttgttgttatgtggagaggatgac

SEQ ID NO: 228 - DNA, 957 bp, Artificial Sequence
  Synthetic construct
gcgcaagtcttgcgtggtacggtgacagacttcccaggcttcgatgaaagagcggacgcggaaacacttcgaaaggcgatgaaagggctcggtactgacgaagagtccattttgacccttcttacgagcaggtcaaacgctcagaggcaagaaatctctgcagcctttaagacactctttggacgtgaccttcttgatgacctcaaatctgagctgacgggaaagtttgagaaactcatcgtagctttgatgaagcccagccgattgtatgatgcttacgaactgaaacacgccctgaaaggagcgggaacgaacgagaaagttttgactgagatcatcgcatcgcggaccccggaagagctcagagccatcaaacaagtctacgaggaggagtacggatcgtcattggaagatgacgtggtgggggatacgtcgggttactaccaacgaatgcttgtcgtgcttttgcaggcaaatcgcgacccggatgcggggatcgacgaggcccaagtggagcaagatgcgcaagcactcttccaggccggtgaactcaaatgggggaccgatgaagagaagtttatcaccatctttggcacgaggagtgtaagtcatctgcgtaaagtattcgataagtatatgacaatctcagggtttcagattgaggagacaattgacagggaaacctccggtaacttggagcagctcttgcttgccgtcgtcaagtccattcgctcgatccctgcgtatctggctgaaacactgtattacgccatgaaaggggcaggcactgatgaccacaccttgattagagttatggtgtcgcgatcagaaattgacttgttcaatatccggaaagagttccggaagaatttcgcaacgagcctctatagcatgatcaaaggggacacttcgggagattacaagaaagcgttgctccttctttcaggagaggatgac

SEQ ID NO: 229 - DNA, 957 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgagttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtgacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagctacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtgatacttcaggtgattacaaaaaggctctgcttttgctgtgtggcgaggacgat

SEQ ID NO: 230 - DNA, 957 bp, Artificial Sequence
  Synthetic construct
gctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagaactgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtgatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggccacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtgatacttccggtgattacaaaaaggctttgttgttgttatgtggagaggatgac

SEQ ID NO: 231 - DNA, 957 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgagttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtaacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagctacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtgatacttcaggtgattacaaaaaggctctgcttttgctgtgtggcgaggacgat

SEQ ID NO: 232 - DNA, 957 bp, Artificial Sequence
  Synthetic construct
gctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagaactgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtaatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggccacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtgatacttccggtgattacaaaaaggctttgttgttgttatgtggagaggatgac

SEQ ID NO: 233 - DNA, 957 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgatttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtaacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagctacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtaacacttcaggtgattacaaaaaggctctgcttttgctgtgtggcgaggacgat

SEQ ID NO: 234 - DNA, 957 bp, Artificial Sequence
  Synthetic construct
gctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagatctgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtaatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggccacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtaatacttccggtgattacaaaaaggctttgttgttgttatgtggagaggatgac

SEQ ID NO: 235 - DNA, 384 bp, Artificial Sequence
  Synthetic construct
gaaaagctgggaaagctgcaatacagtttggactacgatttccaaaacaatcagttgctcgtcggcattatccaggctgccgaattgccagctttagatatgggtggtacatcagatccctacgtcaaagtatttctactgcctgacaaaaagaaaaagtttgaaactaaggtgcacagaaaaacgcttaacccagttttcaacgagcagtttacattcaaagttccttattctgaacttggaggaaaaactctagtgatggccgtttatgatttcgataggttttctaagcatgacatcataggggagtttaaggtcccaatgaatactgttgatttcggtcatgtgaccgaggaatggcgtgaccttcaatccgcagagaaa

SEQ ID NO: 236 - DNA, 762 bp, Artificial Sequence
  Synthetic construct
caggtgcagctcgtccagagcggcgccgaggtgaagaagccaggcgagtccctgaagatctcctgtaagggctccggctacagcttcacctcctactggatcgcttgggtgaggcagatgccaggaaagggactggagtacatgggcctgatctaccctggcgactccgacaccaagtactccccatccttccagggccaggtgaccatcagcgtggacaagtccgtgtctaccgcctacctgcaatggtcctccctgaagccttctgactctgccgtgtacttttgtgcccgggccgatgtgggctactgcaccgaccggacatgtgccaaggcccccgcgtggctgggagtgtggggacagggaacactggtgacagtgagttctggcggtggcggctcttccggcggtggctctggtggcggcggatctcagagcgtgctgacacagccacctagcgtgtccgctgcccctggccagaaggtgacaatcagctgctccggcagctcttccaacatcggcaacaactacgtgtcttggtatcagcagctgcccggaacagctccaaaactgctgatctatgaccacaccaatcggcctgccggcgtgccagatcggttctctggctctaagagcggcacctccgccagcctggctatctctggcttcagatctgaggatgaggctgactactattgtgcctcctgggactacaccctgtctggctgggtgttcggcggtggcaccaagctgacagtcctg

SEQ ID NO: 237 - DNA, 762 bp, Artificial Sequence
  Synthetic construct
caagtccagctggtccagtcaggggcagaagtcaaaaagcctggtgaatctctgaaaatctcatgtaaaggctctggatatagttttacctcatattggatagcttgggttcgtcaaatgcctggtaaaggtttggagtacatgggtctaatctacccaggcgattcggatacaaagtactctccctcttttcaaggtcaagtcactatatccgtagataagtccgtatccaccgcatacctacaatggtcatctttgaagccttctgattctgccgtctacttctgcgctagggctgatgttggttattgtaccgataggacatgtgctaaggctcccgcttggctgggggtgtggggtcaaggcaccttggttacagtgtcctctggcggaggtggttcgtcaggaggcggttctggtggtggcggctcccaatcagtattgacccagcccccttctgtctccgctgctccagggcaaaaggtcaccatcagttgctctggtagttcctctaacattggtaacaattacgtcagctggtatcagcagttaccaggtactgcaccaaagctgttgatctacgaccacaccaacagacccgctggtgtcccagataggttttctggatcaaaatctggcacttcagctagtcttgctatctctggatttcgttccgaggatgaagccgattactactgcgcttcatgggattacactctatcaggctgggtgtttggcggaggcactaaactgacagtgctt

SEQ ID NO: 238 - DNA, 57 bp, Artificial Sequence
  Synthetic construct
  misc_signal (1)..(57)
atgggctggtctctgatcctgctgttcctggtggccgtggccacgcgtgtgctgtcc

SEQ ID NO: 239 - DNA, 258 bp, Artificial Sequence
  Synthetic construct
  misc_signal (1)..(258)
atgatgagatttccttcaatttttactgccgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgataaaaga

SEQ ID NO: 240 - DNA, 255 bp, Artificial Sequence
  Synthetic construct
  misc_signal (1)..(255)
atgagatttccttcaatttttacagcagttttattcgcagcatcctccgcattagccgctccagccaacaccacgacagaggatgaaacggcacaaattccggccgaggctgtcatcgattactcagatctagaaggggatttcgatgctgctgctctgccactttccaacagcacaaataacgggttatcgtctacaaatactactattgccagcattgctgctaaagaagaaggggtacagctggataaaaga

SEQ ID NO: 241 - DNA, 54 bp, Artificial Sequence
  Synthetic construct
  misc_signal (1)..(54)
atgcagttacttcgctgtttttcaatattttctgttattgcttcagttttagca

SEQ ID NO: 242 - DNA, 60 bp, Artificial Sequence
  Synthetic construct
  misc_signal (1)..(60)
atgatgcttttgcaagccttccttttccttttggctggttttgcagccaaaatatctgcg

SEQ ID NO: 243 - DNA, 114 bp, Artificial Sequence
  Synthetic construct
  misc_signal (1)..(114)
atgaaagtcctgattgtgctacttgcgattttcgctgcactaccgcttgcgctggcgcagccagtgattagcaccactgtaggcagcgctgctgaaggtagcctggataaaaga

SEQ ID NO: 244 - protein, 85 aa, Artificial Sequence
  Synthetic construct
  PEPTIDE (1)..(85)
MRFPSIFTAVLFAASSALAAPVNTTTEDETAQIPAEAVIGYSDLEGDFDVAVLPFSNSTNNGLLFINTTIASIAAKEEGVSLEKR

SEQ ID NO: 245 - DNA, 255 bp, Artificial Sequence
  Synthetic construct
  misc_signal (1)..(255)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagg

SEQ ID NO: 246 - protein, 927 aa, Artificial Sequence
  Synthetic construct
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARADVGYCTDRTCAKAPAWLGVWGQGTLVTVSSGGGGSSGGGSGGGGSQSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAALQGPETLCGAELVDALQFVCGDRGFYFNKPTGYGSSSRRAPQTGIVDECCFRSCDLRRLEMYCAPLKPAKSAGGSHHHHHH

SEQ ID NO: 247 - DNA, 2787 bp, Artificial Sequence
  Synthetic construct
caggtgcagctcgtccagagcggcgccgaggtgaagaagccaggcgagtccctgaagatctcctgtaagggctccggctacagcttcacctcctactggatcgcttgggtgaggcagatgccaggaaagggactggagtacatgggcctgatctaccctggcgactccgacaccaagtactccccatccttccagggccaggtgaccatcagcgtggacaagtccgtgtctaccgcctacctgcaatggtcctccctgaagccttctgactctgccgtgtacttttgtgcccgggccgatgtgggctactgcaccgaccggacatgtgccaaggcccccgcgtggctgggagtgtggggacagggaacactggtgacagtgagttctggcggtggcggctcttccggcggtggctctggtggcggcggatctcagagcgtgctgacacagccacctagcgtgtccgctgcccctggccagaaggtgacaatcagctgctccggcagctcttccaacatcggcaacaactacgtgtcttggtatcagcagctgcccggaacagctccaaaactgctgatctatgaccacaccaatcggcctgccggcgtgccagatcggttctctggctctaagagcggcacctccgccagcctggctatctctggcttcagatctgaggatgaggctgactactattgtgcctcctgggactacaccctgtctggctgggtgttcggcggtggcaccaagctgacagtcctgggcgccgcctccgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgaccgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggccgcagctctgcagggcccagaaacactttgtggagccgaactggtggatgctctccaattcgtttgcggcgaccgcggattctactttaacaagcccaccggttacgggtcttcaagccggagggccccgcagactggcatcgtcgacgagtgctgttttagaagctgcgatctgcgacggttggagatgtattgtgcacctctgaagcccgcgaaaagtgctgggggctcccaccatcaccatcaccactagtga

SEQ ID NO: 248 - protein, 1032 aa, Artificial Sequence [sequence omitted]

SEQ ID NO: 249 - DNA, 3102 bp, Artificial Sequence
  Synthetic construct
caggtgcagctcgtccagagcggcgccgaggtgaagaagccaggcgagtccctgaagatctcctgtaagggctccggctacagcttcacctcctactggatcgcttgggtgaggcagatgccaggaaagggactggagtacatgggcctgatctaccctggcgactccgacaccaagtactccccatccttccagggccaggtgaccatcagcgtggacaagtccgtgtctaccgcctacctgcaatggtcctccctgaagccttctgactctgccgtgtacttttgtgcccgggccgatgtgggctactgcaccgaccggacatgtgccaaggcccccgcgtggctgggagtgtggggacagggaacactggtgacagtgagttctggcggtggcggctcttccggcggtggctctggtggcggcggatctcagagcgtgctgacacagccacctagcgtgtccgctgcccctggccagaaggtgacaatcagctgctccggcagctcttccaacatcggcaacaactacgtgtcttggtatcagcagctgcccggaacagctccaaaactgctgatctatgaccacaccaatcggcctgccggcgtgccagatcggttctctggctctaagagcggcacctccgccagcctggctatctctggcttcagatctgaggatgaggctgactactattgtgcctcctgggactacaccctgtctggctgggtgttcggcggtggcaccaagctgacagtcctgggcgccgcctccgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgaccgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggccgcagctctgcagcagcggaaaaggagaaacaccattcacgagtttaagaagtccgcgaagaccacactgattaagattgatcccgcccttaaaatcaagacaaagaaggtgaacacggctgaccagtgtgctaatcgctgcacaaggaataaaggactgccatttacttgtaaagcctttgtattcgataaggcacgcaagcagtgcctctggttccctttcaattctatgagcagtggtgttaagaaagagtttggccatgaattcgacttgtacgaaaacaaagattatatccggaactgcattatcgggaaaggccggtcttacaaaggcaccgtctccataaccaagagtggcatcaaatgtcaaccctggagctcaatgatcccacatgaacactccttcctcccaagttcataccggggcaaggacctgcaagagaactattgcagaaatccgcgaggggaagagggagggccttggtgtttcacttctaatcccgaggtgaggtatgaggtgtgcgacatacctcagtgcggtggaagccaccatcaccaccaccattagtga

SEQ ID NO: 250 - protein, 925 aa, Artificial Sequence
  Synthetic construct
AQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGGGSGGSGGHHHHHH

SEQ ID NO: 251 - DNA, 2781 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgatttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtaacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagctacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtaacacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtggcggaagtggcggatcaggtggtcaccaccatcatcaccattagtga

SEQ ID NO: 252 - protein, 925 aa, Artificial Sequence
  Synthetic construct
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGGGSGGSGGHHHHHH

SEQ ID NO: 253 - DNA, 2781 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgagttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtgacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagagacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtgatacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtggcggaagtggcggatcaggtggtcaccaccatcatcaccattagtga

SEQ ID NO: 254 - protein, 994 aa, Artificial Sequence
  Synthetic construct
STSHLVKCAEKEKTFCVNGGECFMVKDLSNPSRYLCKCPNEFTGDRCQNYVMASFYKHLGIEFMEAEELYQKGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGAQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDGGSHHHHHH

SEQ ID NO: 255 - DNA, 2988 bp, Artificial Sequence
  Synthetic construct
tccacttctcatttggtgaaatgcgccgagaaggagaaaacgttctgcgtgaacggtggtgaatgctttatggtcaaagatctgtctaacccttctcgatatctttgtaagtgtcccaacgagtttactggtgatcgatgtcagaactacgttatggcttccttttacaaacacttgggtatagaattcatggaggccgaggagttgtaccaaaaaggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagatctgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtaatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggccacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtaatacttccggtgattacaaaaaggctttgttgttgttatgtggagaggatgacggaggttcacatcaccatcatcaccattagtga

SEQ ID NO: 256 - protein, 925 aa, Artificial Sequence
  Synthetic construct
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGDTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGGGSGGSGGHHHHHH

SEQ ID NO: 257 - DNA, 2781 bp, Artificial Sequence
  Synthetic cocnstruct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgagttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtaacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagctacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtgatacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtggcggaagtggcggatcaggtggtcaccaccatcatcaccattagtga

SEQ ID NO: 258 - protein, 1051 aa, Artificial Sequence
  Synthetic construct
AQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGMSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSGGSHHHHHH

SEQ ID NO: 259 - DNA, 3159 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgatttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtaacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagctacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtaacacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtatgagtcctttgttgagaaggttgctattagctgcattgttacagttagctcctgctcaggccccagtttctcagccagacgcccctggtcatcaacgtaaggttgtgtcttggattgacgtatacacgagagcaacatgccaaccaagggaagtcgttgttccccttactgttgagttgatggggactgtggctaagcagctggtcccttcatgtgtcaccgtacagagatgtggaggttgttgcccagacgatggactagaatgtgttccaacaggacaacatcaggtgagaatgcaaatactgatgatcagatatccatcttcacaacttggcgaaatgtccctggaagagcactctcaatgcgagtgtcgacccaaaaagaaagatagtggtggttcccatcaccaccatcatcattagtga

SEQ ID NO: 260 - protein, 1108 aa, Artificial Sequence
  Synthetic construct
AQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGMSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDSPRPLCPRCTQHHQRPDPRTCRRRCRRRSFLRCQGRGLELNPDTCRCRKLRRGGSHHHHHH

SEQ ID NO: 261 - DNA, 3330 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgatttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtaacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagctacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtaacacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtatgagtcctttgcttagaaggttgttactggccgcactgcttcaacttgcaccagctcaagccccagtctctcaacctgacgctcccggtcatcagagaaaggtggtatcatggattgatgtgtatactcgtgctacatgccaaccccgtgaggttgttgtacctttgacagtcgaattgatgggaaccgttgccaagcagttagttccttcctgtgtcacagtgcagagatgtggaggatgttgtccagatgatggtttggagtgtgtacctactggccaacatcaggttagaatgcagatcttgatgatacgttacccatcaagtcaactaggtgaaatgtctttggaggaacactcccagtgcgaatgcagacccaaaaagaaagattctgctgttaaaccagactctccaagaccattatgtcccagatgcacgcaacaccatcaaagaccagatccaaggacttgtagacgtagatgcaggaggcgatcctttttgcgatgccaaggtagaggcctagagctgaatcctgacacctgtcgatgtcgaaagttaagacgtggtgggtcacaccaccatcaccatcattagtga

SEQ ID NO: 262 - protein, 1095 aa, Artificial Sequence
  Synthetic construct
AQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCGGSHHHHHH

SEQ ID NO: 263 - DNA, 3291 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgatttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtaacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagctacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtaacacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtcaacgtaaaagacgaaatacaattcatgagttcaaaaagtcagccaaaactacattgattaagattgatcccgctctgaagataaagaccaaaaaggtcaacacagctgaccagtgcgccaacaggtgtaccaggaataagggactaccttttacttgtaaagctttcgtattcgacaaagcaaggaagcaatgtctgtggttcccctttaactctatgtcatctggggtgaaaaaggaatttggccatgaatttgatttgtatgaaaacaaagattacattagaaattgcattatcggcaagggaagatcatacaaaggtacggtttctattactaagtctggaatcaagtgccaaccatggtcatccatgatccctcacgagcacagtttccttccaagttcctaccgtggtaaagacttacaagagaactattgccgaaatcctagaggtgaagagggaggtccatggtgttttacctccaaccctgaagttagatatgaagtctgtgatatacctcagtgtggcggttctcatcatcaccaccaccattagtga

SEQ ID NO: 264 - protein, 1066 aa, Artificial Sequence
  Synthetic construct
AQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKSGGSHHHHHH

SEQ ID NO: 265 - DNA, 3204 bp, Artificial Sequence
  Synthetic construct
gctcaagtgctaaggggaactgttactgattttccaggttttgatgaaagagcagatgctgagactttaaggaaagctatgaaaggattgggtacagacgaggaatccattttgacactattgacatcacgaagtaacgcccagagacaagagatctcagcagctttcaaaaccctgttcggaagagatttgcttgacgatttgaagtctgatttgactggtaagtttgaaaaactaatagttgccctgatgaagccttccagactttatgatgcttacgaacttaagcacgctttgaaaggggctggaacaaatgaaaaagttttgactgagataatcgcatcacgtacccctgaggaactaagagccattaagcaggtatatgaagaggaatacggtagttccttagaggacgacgtcgttggtaacacatctggttactatcagaggatgttggttgtcttgttgcaagctaatagggatcctgatgctggcatcgatgaagcccaagtagagcaggacgcccaagccctgtttcaagcaggcgaattgaagtggggaacggacgaagagaagtttatcaccatcttcggaactcgttctgtatctcatcttagaaaagtattcgacaaatacatgacgatttctggttttcaaattgaggagactattgatagagctacgtctggaaacttagaacagcttttgcttgccgtcgttaagtctataaggagtattccagcctacttagctgaaaccttgtactacgccatgaagggtgctggaactgatgatcataccttgatacgagttatggtaagtcgatcagagattgatttgtttaacattaggaaggagttcaggaaaaactttgctacctcattgtattccatgataaagggtaacacttcaggtgattacaaaaaggctctgcttttgctgtgtggcgaggacgatgctagcgatgctcacaaatctgaagtcgctcatcgtttcaaagacttgggtgaggaaaactttaaggctttagttctgattgcttttgcccaatatcttcaacaatcaccattcgaagatcatgtgaaacttgttaacgaagttaccgaatttgcaaaaacgtgtgtggcagacgaaagtgccgaaaactgtgacaaatcattacacactttgttcggtgacaagttatgcactgttgcaaccctacgtgagacatatggagaaatggcagactgttgcgccaaacaagagcctgaacgaaacgaatgctttctgcagcacaaagacgataatccaaatcttccccgattagttcgtcccgaagtagacgtaatgtgcacagcctttcatgataatgaagagactttcctgaaaaagtacttgtacgaaattgcaagacgtcacccatacttctatgctcccgagttactgtttttcgccaaacgatacaaggcagcctttacagaatgttgccaagcagctgacaaggctgcatgtcttttacctaagttagatgagttaagagacgaaggtaaggcttcctcagcaaaacagagacttaagtgcgcatcccttcaaaagtttggtgagagagctttcaaggcttgggctgtcgccagactgtctcagagatttcctaaggctgaattcgcagaagtctctaagctagtaactgacttgactaaagttcatactgagtgctgtcatggggatttgttggaatgcgcagatgatcgtgcagacttagcaaagtacatctgcgagaaccaagactctatttccagtaagttaaaggaatgttgcgaaaagccactacttgagaagtcccactgtattgctgaagtcgaaaatgatgaaatgcctgctgaccttccatctttggccgctgatttcgttgagtccaaggatgtgtgcaaaaactatgctgaagcaaaagatgtgttcctagggatgttcctgtatgaatatgctcgtcgacatcccgactattccgttgtccttttactgagattggctaagacctacgagacaaccttggagaagtgttgtgctgccgcagatcctcacgagtgttacgcaaaagtgtttgatgagttcaaaccattggttgaagagccacaaaatctaatcaagcagaactgtgaactgtttgaacaattgggcgaatacaaattccaaaatgctctgttagtgagatacaccaaaaaggtcccacaagtttccaccccaactctagtcgaggtgtccagaaatctaggaaaagttggatctaagtgttgtaagcatccagaagctaagaggatgccttgcgctgaggattacttgtctgtggttttgaaccagttatgtgttctacacgagaaaactcctgtctccgacagagttactaagtgctgcacagagtctttggtcaatagaaggccttgtttcagtgccctggaagtcgatgaaacttatgtgcctaaagagttccaagccgaaacgttcacttttcacgctgacatttgtactctttctgagaaggaacgtcagatcaaaaagcagacagcattggtggaattggtaaagcataaaccaaaggctacaaaagagcagctgaaggctgttatggatgattttgcagctttcgtggaaaagtgttgtaaagccgatgataaagagacttgttttgcagaggaggggaaaaagctggttgctgcatcacaagctgccctaggtcttgcagccgctaccggtccagcactgccagaggatggcggatctggtgctttcccacctggacacttcaaggatcctaaaaggttatactgcaaaaacggtgggtttttccttagaattcaccctgatggcagagtcgacggtgttcgtgaaaagagtgacccacatatcaagttacagttacaagccgaagagcgaggagtagtttccatcaaaggcgtctgtgctaacagatatctagctatgaaggaggatggaagattgttggcctctaagtgtgttaccgacgaatgctttttctttgaaaggttggagtccaacaattacaatacttatcgttcacgaaagtatacgtcttggtacgtggctttgaagagaacaggacagtacaaattgggttccaaaactggtcctggtcaaaaagctatactttttctacccatgtctgcaaaatcaggtgggagtcatcaccaccaccatcattagtga

SEQ ID NO: 266 - protein, 918 aa, Artificial Sequence
  Synthetic construct
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDDGGSHHHHHH

SEQ ID NO: 267 - DNA, 2760 bp, Artificial Sequence
  Synthetic construct
gacgctcataagtctgaagttgctcacagattcaaagacttaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagaactgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtgatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggaaacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtgatacttccggtgattacaaaaaggctttgttgttgttatgtggagaggatgacggaggttcacatcaccatcatcaccattagtga

SEQ ID NO: 268 - protein, 918 aa, Artificial Sequence
  Synthetic construct
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGDTSGDYKKALLLLCGEDDGGSHHHHHH

SEQ ID NO: 269 - DNA, 2760 bp, Artificial Sequence
  Synthetic construct
gacgctcataagtctgaagttgctcacagattcaaagacttaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagaactgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtaatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggccacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtgatacttccggtgattacaaaaaggctttgttgttgttatgtggagaggatgacggaggttcacatcaccatcatcaccattagtga

SEQ ID NO: 270 - protein, 918 aa, Artificial Sequence
  Synthetic construct
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGAQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDGGSHHHHHH

SEQ ID NO: 271 - DNA, 2760 bp, Artificial Sequence
  Synthetic construct
gacgctcataagtctgaagttgctcacagattcaaagacttaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagatctgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtaatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggccacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtaatacttccggtgattacaaaaaggctttgttgttgttatgtggagaggatgacggaggttcacatcaccatcatcaccattagtga

SEQ ID NO: 272 - protein, 1097 aa, Artificial Sequence
  Synthetic construct
QRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGAQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDGGSHHHHHH

SEQ ID NO: 273 - DNA, 3297 bp, Artificial Sequence
  Synthetic construct
caacgtaagcgtcgaaacactatccatgagttcaaaaagtctgcaaaaactactttgataaagatagacccagctttgaagataaagacgaaaaaggtcaatactgccgaccagtgtgctaatcgatgtactagaaacaagggcttaccctttacttgtaaggcttttgttttcgacaaagcaaggaagcaatgtttatggttccccttcaattcaatgagttctggtgtgaaaaaggaatttggtcatgaatttgatttgtacgagaacaaagattacattagaaactgcattatcggcaaaggaagatcttacaaggggacggtgtctataacaaagagtggcataaagtgtcaaccatggtctagtatgattccacatgagcactctttccttccctcctcctatcgaggaaaagacctacaagagaactattgtcgaaaccctagaggagaagagggaggcccttggtgctttacgagtaaccctgaggttagatacgaagtttgtgacattccacaatgcggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagatctgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtaatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggccacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtaatacttccggtgattacaaaaaggctttgttgttgttatgtggagaggatgacggaggttcacatcaccatcatcaccattagtga

SEQ ID NO: 274 - protein, 1110 aa, Artificial Sequence
  Synthetic construct
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDSPRPLCPRCTQHHQRPDPRTCRRRCRRRSFLRCQGRGLELNPDTCRCRKLRRGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGAQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDGGSHHHHHH

SEQ ID NO: 275 - DNA, 3336 bp, Artificial Sequence
  Synthetic construct
atgtctcctttgctgagaaggttactattggctgcattgttgcagttagccccagcccaagctcccgtttcccaaccagatgcacctggtcatcaacgaaaggtggtttcctggatcgatgtctacacgagagctacctgtcaaccaagggaagttgtagttcccttaactgtggagcttatgggtacagtagccaagcaattagttccctcatgtgtcactgttcagcgatgtggagggtgttgtcctgacgacggcctagagtgcgtcccaacaggacagcaccaagtgagaatgcaaattctgatgatacgatatcctagttctcagttgggtgaaatgagtttggaggagcattctcaatgcgaatgtagacccaaaaagaaagattccgctgtcaaaccagactctcctagaccactatgcccaagatgcactcaacaccaccagcgtcctgatcctagaacttgtaggcgtagatgtcgtagaagatcattccttagatgtcagggaagaggtcttgaattgaatccagacacctgccgatgtcgtaagctgcgtaggggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagatctgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtaatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggccacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtaatacttccggtgattacaaaaaggctttgttgttgttatgtggagaggatgacggaggttcacatcaccatcatcaccattagtga

SEQ ID NO: 276 - protein, 1053 aa, Artificial Sequence
  Synthetic construct
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAATGAQVLRGTVTDFPGFDERADAETLRKAMKGLGTDEESILTLLTSRSNAQRQEISAAFKTLFGRDLLDDLKSDLTGKFEKLIVALMKPSRLYDAYELKHALKGAGTNEKVLTEIIASRTPEELRAIKQVYEEEYGSSLEDDVVGNTSGYYQRMLVVLLQANRDPDAGIDEAQVEQDAQALFQAGELKWGTDEEKFITIFGTRSVSHLRKVFDKYMTISGFQIEETIDRATSGNLEQLLLAVVKSIRSIPAYLAETLYYAMKGAGTDDHTLIRVMVSRSEIDLFNIRKEFRKNFATSLYSMIKGNTSGDYKKALLLLCGEDDGGSHHHHHH

SEQ ID NO: 277 - DNA, 3165 bp, Artificial Sequence
  Synthetic construct
atgagtcctttgctaagacgtttacttttggctgccttattgcagctggcaccagcccaagcaccagtgtcacagccagatgctcccggtcaccagagaaaagtggttagttggattgatgtttacacgagggctacatgccaacctagagaagtagttgtccctctgacagttgaactaatggggaccgttgctaagcaattggtgccttcctgtgtcactgttcagcgatgcggaggatgttgtccagacgacggtctggaatgcgtaccaactggccaacatcaagtcagaatgcagatcttgatgataagatatccatcttcccaattaggagaaatgtcacttgaggaacattctcaatgtgagtgtaggcccaaaaagaaggattctggagctgcaagtgacgctcataagtctgaagttgctcacagattcaaagacctaggtgaagagaactttaaggctcttgtacttatagcatttgctcagtatctgcaacagagtcccttcgaagatcatgtcaagctggtgaatgaggtaaccgaattcgccaagacttgtgtggctgatgaatccgccgaaaactgtgacaaatctttacacacattgttcggagataaactatgcacagtagcaactttacgtgaaacttatggtgagatggcagattgttgtgctaaacaggagcctgagagaaatgaatgctttttgcaacacaaggacgacaatcctaaccttcccagattggttagacccgaggttgacgttatgtgtaccgccttccacgacaatgaggaaacatttctgaaaaagtacttgtacgaaattgcacgacgtcacccatacttctatgcacctgagcttttgtttttcgccaaaagatacaaggcagctttcactgagtgctgtcaagcagccgataaggctgcttgtctattacctaaacttgatgagcttagagatgagggtaaagcatcctccgctaaacagaggttgaaatgtgccagtttgcagaagtttggtgaacgtgctttcaaggcatgggctgttgctagattatctcaaagatttcctaaggccgaatttgctgaggtgtcaaagttggtgacggatttgactaaggtccacactgagtgttgccatggtgatcttttggaatgtgctgacgatagagccgacctggccaagtatatctgtgaaaaccaagattctatcagtagtaagctgaaggaatgttgcgaaaaacctctactagagaaatctcattgcatcgcagaagttgaaaacgatgaaatgccagccgacttgcccagtctggctgctgatttcgtcgagtcaaaagatgtttgcaaaaactatgccgaagcaaaggatgtctttttgggcatgtttctgtacgaatatgctcgtcgtcatcctgactattccgttgtcctgttgctaagactagctaaaacgtatgaaacgaccttggaaaagtgttgcgctgcagctgatccccacgagtgttatgcaaaagttttcgatgagtttaagccacttgtagaagagccacagaacttgatcaaacagaattgtgagcttttcgagcaattaggtgagtataagtttcaaaacgctttgctggttagatataccaaaaaggtcccacaagtgtcaacccctaccctggtagaagtgagtagaaatctaggaaaagtcggatctaagtgctgcaagcatccagaagctaagagaatgccttgcgctgaggattacttgtcagtagttttgaatcagttgtgcgtcctacatgaaaagacacccgtttctgatagagtcactaagtgttgtactgagtctctagtaaacagaaggccttgtttctctgcattagaagtagatgaaacctatgtcccaaaggagttccaagctgaaacctttacatttcacgccgacatttgtacgctatctgagaaggagcgtcagatcaaaaagcaaacagcccttgttgagcttgtgaagcacaagccaaaagctacaaaggagcaattgaaagccgtcatggacgatttcgccgcatttgttgagaagtgttgcaaggcagatgataaggaaacttgttttgctgaagagggcaaaaagcttgttgccgcctctcaagctgctttgggactagccgctgctaccggtgctcaagttttgaggggaaccgttaccgacttcccaggttttgacgaaagagccgacgcagaaacattaaggaaagccatgaagggcttaggcaccgatgaggagtccattctgacactgttgacttcccgatccaatgcccaaaggcaggagatttcagccgctttcaagactttgtttggtagagatcttctggacgacctgaaatcagatctgactggaaagtttgagaaacttattgttgctttgatgaagccttcaagactatatgacgcatacgagttgaaacatgcattgaaaggtgcaggaactaatgaaaaagtgttaactgagatcattgcttccagaacaccagaagagcttcgtgctatcaaacaagtgtatgaagaggaatacggatcaagtctggaagatgacgttgttggtaatacctcagggtattaccaaaggatgcttgtcgttctattacaagctaatcgagatcctgacgccggaatcgatgaagctcaagttgaacaagatgctcaggctctttttcaagccggtgaattgaagtgggggactgatgaggaaaagtttatcacgatctttggtactagatctgttagtcatttgagaaaagtatttgacaaatacatgaccatttctggctttcaaatagaagagactattgatagggccacttccggtaacttggaacaactgttgttagctgtggtcaagagtataagatcaattccagcttacttagctgaaactctgtattacgcaatgaaaggagcaggcacagacgatcacacgttgatccgagtcatggtttccagatcagagattgacttgttcaatatcaggaaggaattcaggaaaaactttgcaacctctttgtactccatgatcaaaggtaatacttccggtgattacaaaaaggctttgttgttgttatgtggagaggatgacggaggttcacatcaccatcatcaccattagtga

We claim:

1. A bi-specific fusion protein comprising:
   (a) a targeting domain comprising a sequence recited in SEQ ID NO: 81, the targeting domain having a binding specificity to phosphatidylserine associated with the surface of a cell of a tissue; and
   (b) a growth factor comprising a sequence recited in any one of SEQ ID NOs: 3-5, 39-40, or 55-56, the growth factor having a binding specificity to a growth factor receptor associated with the surface of the same cell,
   wherein upon exposure of the growth factor to the growth factor receptor, the growth factor binds to the growth factor receptor at the surface of the cell so as to modulate regeneration or survival of the tissue.

2. The bi-specific fusion protein of claim 1 further comprising a peptide half-life modulator comprising a sequence recited in any one of SEQ ID NOs: 10, 12, 14-29, 45-49, 65-71, or 105, wherein the half-life modulator modulates the half-life of the bi-specific fusion protein.

3. The bi-specific fusion protein of claim 1 wherein the targeting domain is at the amino terminus of the growth factor or wherein the targeting domain is at the carboxy terminus of the growth factor.

4. The bi-specific fusion protein of claim 2 wherein the half-life modulator is a non-immunogenic protein.

5. The bi-specific fusion protein of claim 2 further comprising a connector linking the half-life modulator to the fusion protein.

6. The bi-specific fusion protein of claim 2 wherein the bi-specific fusion protein exhibits an in vivo half-life of between 2 hours and 24 hours, greater than 24 hours, or greater than one week.

7. The bi-specific fusion protein of claim 1 wherein the fusion protein promotes cell recruitment, inhibition of apoptosis, induction of cell proliferation, cell growth, motility of stem cells, differentiation of stem cells, and/or prevents cell damage.

8. The bi-specific fusion protein claim 1 wherein the tissue is cardiac tissue, kidney tissue, bone, cartilage, joints, skin, liver tissue, pancreatic tissue, blood cells, lung tissue, and nervous tissue.

9. The bi-specific fusion protein of claim 1 further comprising a leader polypeptide.

10. The bi-specific fusion protein of claim 9 wherein the leader polypeptide comprises a sequence recited in SEQ ID NOs: 41-42, 87-91 or 244.

11. A pharmaceutical composition comprising a pharmaceutical suitable carrier and a therapeutically effective amount of the bi-specific fusion protein claim 1.

12. An isolated nucleic acid molecule encoding the bi-specific fusion protein according to claim 1.

13. The bi-specific fusion protein of claim 1 wherein the growth factor is joined via a peptide bond to the amino terminus of the targeting domain or wherein the growth factor is joined via a peptide bond to the carboxy terminus of the targeting domain.

14. A fusion protein comprising:
   (a) at least one targeting domain comprising a sequence recited in SEQ ID NO: 81, the at least one targeting domain having a binding specificity to phosphatidylserine associated with a surface of a cell in a tissue;
   (b) an activator domain comprising at least one growth factor having SEQ ID NO: 3, or at least one growth factor having SEQ ID NO: 4, or at least one growth factor having SEQ ID NO: 5, or at least one growth factor having SEQ ID NO: 39, or at least one growth factor having SEQ ID NO: 40, or at least one growth factor having SEQ ID NO: 55, or at least one growth factor having SEQ ID NO: 56, the at least one growth factor having a binding specificity to a growth factor receptor associated with the surface of the same cell, wherein the at least one targeting domain and the at least one growth factor bind to different molecules at the surface of the same cell, and
   (c) a half-life modulator comprising a sequence recited in any one of SEQ ID NOs: 10, 12, 14-29, 45-49, 65-71, or 105, wherein the half-life modulator modulates the half-life of the fusion protein,
   wherein upon exposure of the at least one growth factor to the growth factor receptor, the at least one growth factor binds to the growth factor receptor at the surface of the cell so as to promote regeneration or survival of the tissue.

15. The fusion protein of claim 14 wherein the at least one targeting domain is joined via a peptide bond to the amino terminus of the half-life modulator and the at least one growth factor is joined via a peptide bond to the carboxy terminus of the half-life modulator.

16. The fusion protein of claim 14 wherein the at least one targeting domain is joined via a peptide bond to the carboxy terminus of the half-life modulator and the at least one growth factor is joined via a peptide bond to the amino terminus of the half-life modulator.

17. The bi-specific fusion protein of claim 2 wherein the targeting domain is joined via a peptide bond to the amino terminus of the half-life modulator and the growth factor is joined via a peptide bond to the carboxy terminus of the half-life modulator.

18. The bi-specific fusion protein of claim 2 wherein the targeting domain is joined via a peptide bond to the carboxy terminus of the half-life modulator and the growth factor is joined via a peptide bond to the amino terminus of the half-life modulator.

19. A bi-specific fusion protein comprising:
   (a) a targeting domain comprising a sequence recited in SEQ ID NO: 82, the targeting domain having a binding specificity to phosphatidylserine associated with the surface of a cell of a tissue; and (b) a growth factor comprising a sequence recited in any one of SEQ ID NOs: 3-9, 32-40, 50-56, or 59-64, the growth factor having a binding specificity to a growth factor receptor associated with the surface of the same cell, wherein upon exposure of the growth factor to the growth factor receptor, the growth factor binds to the growth factor receptor at the surface of the cell so as to modulate regeneration or survival of the tissue.

20. A bi-specific fusion protein comprising:

(a) a targeting domain comprising a sequence recited in SEQ ID NO: 83, the targeting domain having a binding specificity to phosphatidylserine associated with the surface of a cell of a tissue; and (b) a growth factor comprising a sequence recited in any one of SEQ ID NOs: 3-9, 32-40, 50-56, or 59-64, the growth factor having a binding specificity to a growth factor receptor associated with the surface of the same cell, wherein upon exposure of the growth factor to the growth factor receptor, the growth factor binds to the growth factor receptor at the surface of the cell so as to modulate regeneration or survival of the tissue.

21. A bi-specific fusion protein comprising:

(a) a targeting domain comprising a sequence recited in SEQ ID NO: 31, the targeting domain having a binding specificity to phosphatidylserine associated with the surface of a cell of a tissue; and (b) a growth factor comprising a sequence recited in any one of SEQ ID NOs: 4-9, 32-40, 50-56, or 59-64, the growth factor having a binding specificity to a growth factor receptor associated with the surface of the same cell, wherein upon exposure of the growth factor to the growth factor receptor, the growth factor binds to the growth factor receptor at the surface of the cell so as to modulate regeneration or survival of the tissue.

\* \* \* \* \*

UNITED STATES PATENT AND TRADEMARK OFFICE
CERTIFICATE OF CORRECTION

PATENT NO. : 9,238,080 B2  
APPLICATION NO. : 13/068808  
DATED : January 19, 2016  
INVENTOR(S) : Ulrik Nielsen et al.

Page 1 of 1

It is certified that error appears in the above-identified patent and that said Letters Patent is hereby corrected as shown below:

Claims

Column 67, Line 52, Claim 8 replace the words "The bi-specific fusion protein claim 1" with --The bi-specific fusion protein of claim 1--;

Column 67, Line 63, Claim 11 replace the words "amount of the bi-specific fusion protein claim 1" with --amount of the bi-specific fusion protein of claim 1--.

Signed and Sealed this  
Twenty-sixth Day of April, 2016

Michelle K. Lee  
*Director of the United States Patent and Trademark Office*